(12) United States Patent
Campbell et al.

(10) Patent No.: US 8,178,339 B2
(45) Date of Patent: May 15, 2012

(54) **REDUCED GENOME *E. COLI***

(75) Inventors: John W Campbell, Oak Park, IL (US);
Frederick R. Blattner, Madison, WI (US); Guy Plunkett, Madison, WI (US); Gyorgy Posfai, Szeged (HU)

(73) Assignee: Scarab Genomics LLC, Madison, WI (US)

( * ) Notice: Subject to any disclaimer, the term of this patent is extended or adjusted under 35 U.S.C. 154(b) by 557 days.

(21) Appl. No.: 12/064,332

(22) PCT Filed: Aug. 18, 2006

(86) PCT No.: PCT/US2006/032525
§ 371 (c)(1),
(2), (4) Date: Jul. 16, 2008

(87) PCT Pub. No.: WO2007/024756
PCT Pub. Date: Mar. 1, 2007

(65) Prior Publication Data
US 2009/0075333 A1    Mar. 19, 2009

(51) Int. Cl.
*C12P 21/04* (2006.01)
*C12P 19/34* (2006.01)
*C12N 1/20* (2006.01)

(52) U.S. Cl. .......... 435/252.33; 435/69.1; 435/91.1

(58) Field of Classification Search .......... None
See application file for complete search history.

(56) References Cited

U.S. PATENT DOCUMENTS

2003/0138937 A1    7/2003    Blattner

OTHER PUBLICATIONS

International Search Report of PCT/U2006/032525 dated Feb. 20, 2007.
Kolisnychenko, V., et al., "Engineering a Reduced *Escherichia coli* Genome," Genome Research, vol. 12, No. 4, pp. 640-647 (2002) (XP002317216).
Posfai, G., et al., "Emergent Properties of Reduced-Genome *Escherichia coli*," Science, vol. 312, No. 5776, pp. 1044-1046 (2006) (XP 0024100684).
Yu, B., et al., "Minimization of the *Escherichia coli* Genome Using a Tn5-Targeted CRE/10xP Excision System," Nature Biotechnology, vol. 20, No. 10, pp. 1018-1023 (2002) (XP-002327128).

*Primary Examiner* — Robert A Zeman
(74) *Attorney, Agent, or Firm* — Morgan, Lewis & Bockius LLP

(57) ABSTRACT

Reduced genome strains of *E. coli* MG1655 are described. In various embodiments, the strains have one or more of equal or improved growth rate, transformation efficiency, protein expression, DNA production, DNA yield and/or DNA quality compared to the parental strain and commercially available strains.

5 Claims, 6 Drawing Sheets

REDUCED GENOME E. COLI

FIELD OF THE INVENTION

The present invention relates to strains of microorganisms and processes involving these microorganisms. More specifically, the present invention relates to genetically modified strains of microorganisms and the use thereof for the production of commercial products, such as recombinant proteins, nucleic acids, such as DNA, and amino acids. The present invention also relates to methods of preparing strains of microorganisms for such uses.

BACKGROUND OF THE INVENTION

Bacteria have been used to produce a wide range of commercial products. For example, many Streptomyces strains and *Bacillus* strains have been used to produce antibiotics; *Pseudomanas denitrificans* and many Propionibacterium strains have been used to produce vitamin B12; some other bacteria have been used to produce vitamin Riboflavin; *Brevibacterium flavum* and *Corynebacterium glutamicum* have been used to produce lysine and glutamic acid, respectively, as food additives; other bacteria have been used to produce other amino acids used as food additives; *Alcaligenes eutrophas* has been used to produce biodegradable microbial plastics; and many Acetobacter and Gluconobacter strains have been used to produce vinegar. More recently, it has become common for bacteria, such as *Escherichia coli* (*E. coli*), to be genetically engineered and used as host cells for the production of biological reagents, such as proteins and nucleic acids, in laboratory as well as industrial settings. The pharmaceutical industry supports several examples of successful products which are human proteins which are manufactured in *E. coli* cultures cultivated in a fermenter.

It is not an uncommon occurrence for normal bacterial proteins to adversely affect the production or the purification of a desired protein product from an engineered bacteria. For example, when *E. coli* bacteria are used as host cells to generate a large quantity of a desired product encoded by a gene that is introduced into the host cells by a plasmid, certain normal *E. coli* gene products can interfere with the introduction and maintenance of plasmid DNA. More significantly, because of the economies of bacterial culture in making proteins in bacteria, often the cost of purification of a recombinant protein can be more than the cost of production, and some of the natural proteins produced by the bacterial host are sensitive to purification procedures. Further, many bacterial strains produce toxins that must be purified away from the target protein being produced and some strains can produce, by coincidence, native proteins that are close in size to the target protein, thereby making size separation ineffective for the purification process.

The genome of a bacteria used in a fermenter to produce a recombinant protein includes many unnecessary genes. A bacteria living in a natural environment has many condition responsive genes to provide mechanisms for surviving difficult environmental conditions of temperature, stress or lack of food source. Bacteria living in a fermentation tank do not have these problems and hence do not require these condition responsive genes. The bacterial host spends metabolic energy each multiplication cycle replicating these genes. Thus the unnecessary genes and the unneeded proteins, produced by a bacterial host used for production of recombinant protein, result in a lack of efficiencies in the system that could be improved upon.

It is not terribly difficult to make deletions in the genome of a microorganism. One can perform random deletion studies in organisms by simply deleting genomic regions to study what traits of the organism are lost by the deleted genes. It is more difficult, however, to make targeted deletions of specific regions of genomic DNA and more difficult still if one of the objectives of the method is to leave no inserted DNA or mutations, here termed a "scar," in the genome of the organism after the deletion. If regions of inserted DNA or mutations, i.e. scars, are left behind after a genomic deletion procedure, those regions can be the locations for unwanted recombination events that could excise from the genome regions that are desirable or engender genome rearrangements. In building a series of multiple deletions, scars left behind in previous steps could become artifactual targets for succeeding steps of deletion. This is especially so when the method is used repeatedly to generate a series of deletions from the genome. In other words, the organism becomes by the deletion process genetically unstable if inserted DNA or mutations are left behind.

BRIEF DESCRIPTION OF SEQUENCE LISTING, TABLES AND COMPUTER PROGRAM LISTING

A sequence listing is attached to the present application in a file named SEQ.txt (5740 KB, 19 May 5), and is hereby incorporated by reference herein.

SUMMARY OF THE INVENTION

In one embodiment of the invention, a reduced genome strain is provided, which may be lacking the nucleic acid regions shown on Table 2 or a region with a sequence substantially identical thereto and the following ranges of nucleic acid sequences with reference to SEQ ID NO: 1: 167484-169727, 169778-170575, 170575-171465 and 171462-173444 or a sequence substantially identical thereto. The genome of the strain may be further lacking the following range of nucleic acid sequence with reference to SEQ ID NO: 1: 3088369-3089076 or a sequence substantially identical thereto. The genome of the strain may also be further lacking the following range of nucleic acid sequence with reference to SEQ ID NO: 1: 2820730-2821791 or a sequence substantially identical thereto.

In another embodiment, the invention provides a strain of *E. coli* lacking one or more of the nucleic acid regions shown on any of Tables 1-20, or sequences substantially identical thereto.

In still another embodiment, the invention provides a strain of *E. coli* lacking one or more of the nucleic acid regions shown on any of Tables 1-20, or sequences substantially identical thereto.

The parent of the reduced genome strain may be *E. coli*. The parent of the reduced genome strain may also be *E. coli* MG1655. The genomic sequence of the parent of the reduced genome strain may be the sequence set forth in SEQ ID NO: 1 or a sequence substantially identical thereto.

The strain may comprise a heterologous nucleic acid. The genome of the strain may comprise the heterologous nucleic acid. The heterologous nucleic acid may be a vector, such as a plasmid. The plasmid may also comprise a heterologous nucleic acid. The heterologous nucleic acid may be operatively linked to an expression control sequence. The strain may be used to produce a polypeptide by expressing a polypeptide encoded by the heterologous nucleic acid. The heterologous nucleic acid may be introduced into the strain by transforming the strain with the heterologous nucleic acid. The heterologous nucleic acid may be amplified in the strain.

DETAILED DESCRIPTION OF THE INVENTION

Figure 1:
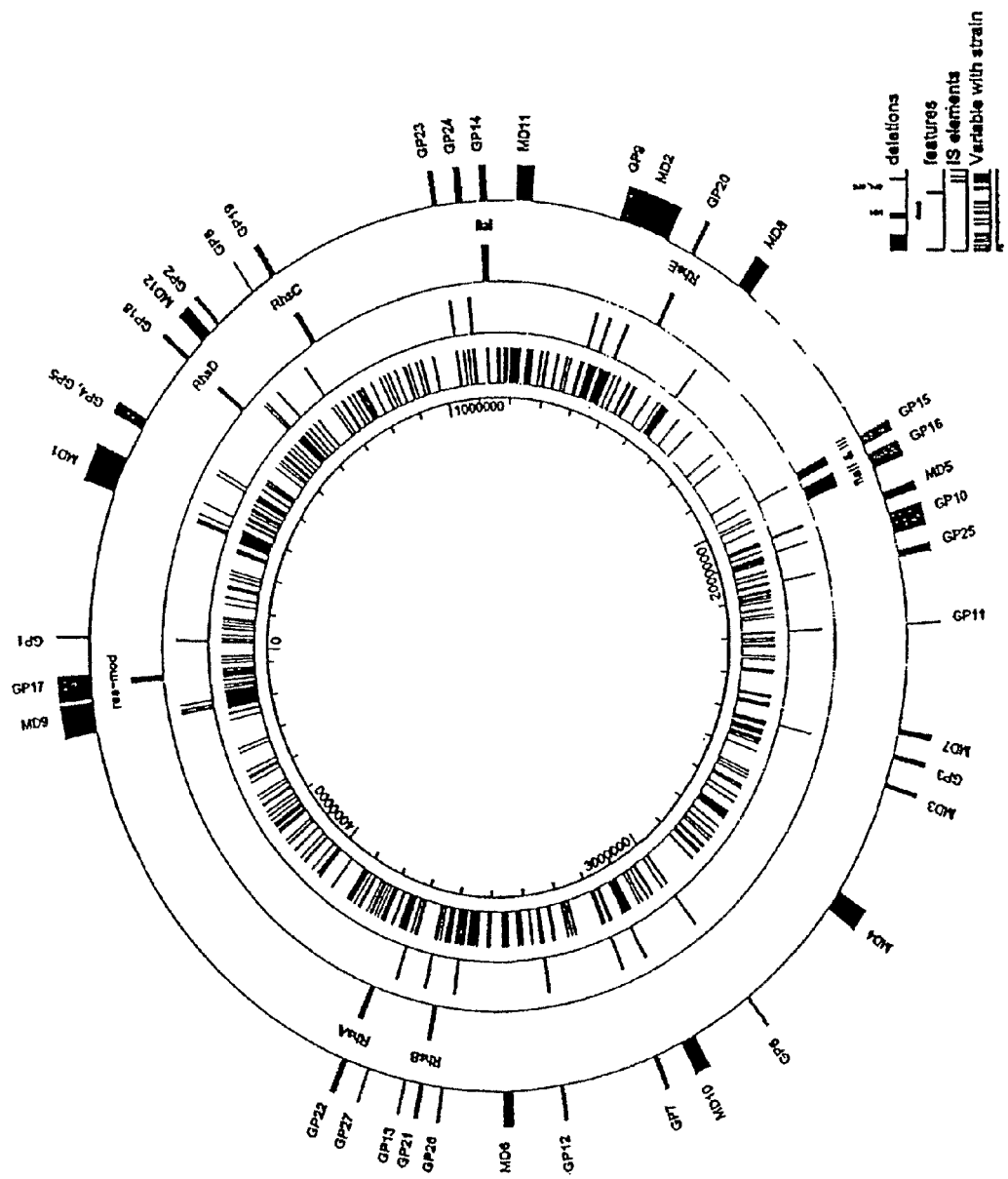
FIG. 1 is an illustration of the original release of the E. coli K-12 genome (strain MG1655-annotation version m54), which natively comprises 4,639,221 nucleotides or base pairs. The inner ring of FIG. 1 shows the scale of the base pair positions without deletions (see also Blattner et al., infra). The next ring progressively outward shows regions of the K-12 genome that are missing or highly altered in a related strain O157:H7, and which are thus potentially deletable from the K-12 genome. The next ring outward shows the positions of the IS elements, both complete and partial, in the native genome. The next ring moving outward shows the positions of the RHS elements A to E and flagellar and restriction regions. The outermost ring shows the location of the deletions actually made to the genome, as described in U.S. Patent Publication No. 20030138937 and International Patent Publication No. WO 2003/070880, the contents of which are incorporated herein by reference, which delete up to about 14 percent of the base pairs in the original K-12 MG1655 genome.

While the present invention is capable of being embodied in various forms, the description below of several embodiments is made with the understanding that the present disclosure is to be considered as an exemplification of the invention, and is not intended to limit the invention to the specific embodiments illustrated. Headings are provided for convenience only and are not to be construed to limit the invention in any way. Embodiments illustrated under any heading may be combined with embodiments illustrated under any other heading.

The use of numerical values in the various ranges specified in this application, unless expressly indicated otherwise, are stated as approximations as though the minimum and maximum values within the stated ranges were both preceded by the word "about." In this manner, slight variations above and below the stated ranges can be used to achieve substantially the same results as values within the ranges. As used herein, the terms "about" and "approximately" when referring to a numerical value shall have their plain and ordinary meanings to one skilled in the pertinent at issue. Also, the disclosure of ranges is intended as a continuous range including every value between the minimum and maximum values recited as well as any ranges that can be formable thereby.

It is also to be understood that any ranges, ratios and ranges of ratios that can be formed by any of the numbers or data present herein represent further embodiments of the present invention. This includes ranges that can be formed that do or do not include a finite upper and/or lower boundary. Accordingly, the skilled person will appreciate that many such ratios, ranges, and ranges of ratios can be unambiguously derived from the data and numbers presented herein and all represent embodiments of the present invention.

Before the present compounds, products and compositions and methods are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

1. DEFINITIONS

"Base pair" used herein may refer to the hydrogen bonded nucleotides of, for example, adenine (A) with thymine (T), or of cytosine (C) with guanine (G) in a double-stranded DNA molecule. In RNA, uracil (U) is substituted for thymine. Base pair may also be used as a unit of measure for DNA length.

"Clone" used in reference to an insert sequence and a vector may mean ligation of the insert sequence into the vector or its introduction by recombination either homologous, site specific or illegitimate as the case may be. When used in reference to an insert sequence, a vector, and a host cell, the term may mean to make copies of a given insert sequence. The term may also refer to a host cell carrying a cloned insert sequence, or to the cloned insert sequence itself.

"Complement," "complementary" or "complementarity" used herein may mean Watson-Crick or Hoogsteen base pairing between nucleotides or nucleotide analogs of nucleic acid molecules. For example, the sequence 5'-A-G-T-3' is complementary to the sequence 3'-T-C-A-5'. Complementarity may be "partial," in which only some of the nucleotides are matched according to the base pairing rules. Or, there may be "complete" or "total" complementarity between the nucleic acids. The degree of complementarity between nucleic acid strands may have effects on the efficiency and strength of hybridization between nucleic acid strands.

"Encoding" or "coding" used herein when referring to a nucleic acid may mean a sequence of nucleotides, which upon transcription into RNA and subsequent translation into protein, would lead to the synthesis of a given protein, peptide or amino acid sequence. Such transcription and translation may actually occur in vitro or in vivo, or may be strictly theoretical based on the standard genetic code.

"Enzyme" used herein may mean a protein which acts as a catalyst to induce a chemical change in other compounds, thereby producing one or more products from one or more substrates. Enzymes are referred to herein using standard nomenclature or by their EC number, as recommended by the Nomenclature Committee of the International Union of Biochemistry and Molecular Biology as of Mar. 11, 2004.

"Expression control sequence" used herein may mean a promoter or array of transcription factor binding sites that direct transcription of a nucleic acid operatively linked thereto.

"Free end" used in reference to a double-stranded nucleic acid may mean a linear nucleic acid with blunt free ends or sticky free ends, or a combination thereof.

"Gene" used herein may refer to a nucleic acid (e.g., DNA or RNA) that comprises a nucleic acid sequence encoding a polypeptide or precursor thereto. The polypeptide can be encoded by a full length coding sequence or by any portion of the coding sequence so long as the desired activity or functional properties (e.g., enzymatic activity, ligand binding, signal transduction, antigenicity etc.) of the full-length or fragment are retained. The term also encompasses the sequences located adjacent to the coding region on both the 5' and 3' ends that contribute to the gene being transcribed into a full-length mRNA. The term "gene" encompasses both cDNA and genomic forms of a gene. A genomic form or clone of a gene may contain the coding region interrupted with non-coding sequences termed (e.g., introns).

"Introduce" or "introduced" when used in reference to adding a nucleic acid to a strain, may mean that the nucleic acid may be integrated into the chromosome of the strain or contained on a vector, such as a plasmid, in the strain.

"Library" used herein may refer to a plurality of vectors each comprising an insert sequence or to a plurality of nucleotide fragments.

"Mutant" or "mutagenesis" used herein may mean any modification to the nucleic acid of a parent strain. Mutagenesis of nucleic acid may be of any type including, but not limited to, deletion, insertion, substitution, rearrangement, and suppressor and point mutations.

"Nucleic acid" used herein may mean any nucleic acid containing molecule including, but not limited to, DNA or RNA. The term encompasses sequences that include any base analogs of DNA and RNA including, but not limited to, 4-acetylcytosine, 8-hydroxy-N-6-methyladenosine, aziridinylcytosine, pseudoisocytosine, 5-(carboxyhydroxylmethyl) uracil, 5-fluorouracil, 5-bromouracil, 5-carboxymethylaminomethyl-2-thiouracil, 5 carboxymethylaminomethyluracil, dihydrouracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracils, 5-methoxyaminomethyl-2-thiouracil, ÿ-D-maninosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5-oxyacetic acid methylester, uracil-5-oxyacetic acid, pseudouracil, queosine, 2-thiocytosine, and 2,6-diaminopurine.

"Nucleotide" used herein may refer to a monomeric unit of nucleic acid (e.g. DNA or RNA) consisting of a pentose sugar moiety, a phosphate group, and a nitrogenous heterocyclic base. The base may be linked to the sugar moiety via the glycosidic carbon (1' carbon of the pentose). The combination of base and sugar may be called a nucleoside. When the nucleoside contains a phosphate group bonded to the 3' or 5' position of the pentose, it may be referred to as a nucleotide. A sequence of operatively linked nucleotides may be referred to as a "base sequence" or "nucleotide sequence" or "nucleic acid sequence," and may be represented herein by a formula whose left to right orientation is in the conventional direction of 5'-terminus to 3'-terminus.

"Operably linked" used herein may refer to an expression control sequence and downstream polynucleotide, such that productive transcription of the polynucleotide is initiated at the expression control sequence.

"Overexpressing" used herein may mean that the total cellular activity of protein encoded by a gene is increased. The total cellular activity of a protein may be due to increased cellular amounts of a protein, or increased half-life of the protein. Total cellular amounts of a protein may be increased by methods including, but not limited to, amplification of the gene coding said protein or operatively linking a strong promoter to the gene coding said protein.

"Protein" used herein may mean a peptide, polypeptide and protein, whether native or recombinant, as well as fragments, derivatives, homologs, variants and fusions thereof.

"Region of comparison" used herein when referring to a genome may be $1 \times 10^7$, $1.5 \times 10^7$, $2 \times 10^7$, $2.5 \times 10^7$, $3 \times 10^7$, $3.5 \times 10^6$, $4 \times 10^7$ or more nucleotides or base pairs, and when referring to a nucleic acid sequence may be 50, 100, 250, 500, $10^3$, $5 \times 10^3$, $10^4$, $5 \times 10^4$, $10^5$, $5 \times 10^5$, $10^6$ or more nucleotides or more base pairs.

"Stringent hybridization conditions" used herein may mean conditions under which a first nucleic acid sequence will specifically or selectively hybridize to a second nucleic acid sequence, such as in a complex mixture of nucleic acids, but to no other sequences. Stringent conditions are sequence-dependent and will be different in different circumstances. Generally, stringent conditions are selected to be about 5-10° C. lower than the thermal melting point (Tm) for the specific sequence at a defined ionic strength pH. The Tm may be the temperature (under defined ionic strength, pH, and nucleic concentration) at which 50% of the first sequence hybridizes to the second sequence at equilibrium (as the second sequences are present in excess, at Tm, 50% of the first sequence are occupied at equilibrium). Stringent conditions may be those in which the salt concentration is less than about 1.0 M sodium ion, typically about 0.01-1.0 M sodium ion concentration (or other salts) at pH 7.0 to 8.3 and the temperature is at least about 30° C. for short nucleic acid sequences (e.g., about 10-50 nucleotides) and at least about 60° C. for long nucleic acid sequences (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

"Substantially complementary" used herein may mean that a first sequence is at least 60%, 65%, 70%, 75%, 80%, 85%, 90%, 95%, 97%, 98% or 99% identical to the complement of a second sequence over a region of comparison or that the two sequences hybridize under stringent hybridization conditions.

"Substantially identical" used herein may mean that a first and second sequence are at least 60%, 65%, 70%, 75%, 80%, 85%, 90%, 95%, 97%, 98% or 99% identical or substantially complementary over a region of comparison. A reference sequence and a test sequence may be aligned, manually or by a computer algorithm (e.g., GAP, BESTFIT, FASTA and TFAST), and the percentage identity calculated by dividing "the total number of identical residues" by "the total number of residues in the reference sequence" and then multiplying by 100.

2. REDUCED GENOME STRAINS

Bacteria in their natural environment are exposed to many conditions that are not normally experienced in standard industrial or laboratory growth, and thus carry a large number of condition-dependent, stress-induced genes or otherwise nonessential genes which may not be needed in industrial or laboratory use of the organisms. It was realized that much of the genetic information contained within the genome of a bacteria strain could be deleted without detrimental effect to use of bacteria cultures in processes of industrial or laboratory importance. It was also recognized that a bacterium with a reduced genome might be advantageous over native strains in many industrial and laboratory applications. For example, a bacterium with a reduced genome is at least somewhat less metabolically demanding and thus can produce a desired product more efficiently. In addition, a reduced genome can lead to fewer native products and lower levels of certain native proteins, allowing easier purification of a desired protein from the remaining bacterial proteins. Furthermore, some bacterial genetic sequences are associated with instabilities that can interfere with standard industrial or laboratory practices, and might entail costly and burdensome quality control procedures.

The reduced genome strain may have a genome that is at least two percent (2%), five percent (5%), seven percent (7%) to eight percent (8%) to fourteen percent (14%) to eighteen percent (18%) to twenty percent (20%), to forty percent (40%) to sixty percent (60%) smaller than the genome of its native parental strain. The percentage by which a genome has become smaller after a series of deletions is calculated by dividing "the total number of base pairs deleted after all of the deletions" by "the total number of base pairs in the genome of the parental strain before all of the deletions" and then multiplying by 100.

The reduced genome strain may also have a genome that has about 5% to about 10%, about 10% to about 20%, about 30% to about 40%, or about 60% of its protein encoding genes deleted. The percentage by which a genome has had protein encoding genes deleted is calculated by dividing "the total number of protein encoding genes deleted after all of the deletions" by "the total number of protein encoding genes in the genome of the parental strain before all of the deletions" and then multiplying by 100.

The genes and other nucleic acid sequences deleted from the genome may not adversely affect the rate of survival and proliferation of the reduced genome strain under specific growth conditions. Whether a level of adverse effect is acceptable depends on a specific application. For example, a 30% reduction in proliferation rate may be acceptable for one application but not another. In addition, adverse effect of deleting a nucleic acid sequence from the genome may be reduced by measures such as changing culture conditions. Such measures may turn an unacceptable adverse effect to an acceptable one. The proliferation rate may be increased or approximately the same as the parental strain. The proliferation rate may also be from about 5%, 10%, 15%, 20%, 30%, 40% to about 50% lower than that of the parental strain. The doubling time of the reduced genome strain may range from about thirty minutes to about three hours.

a. Parent

The parental strain may be any bacteria strain or other organism, as well as an intermediate strain from which the reduced genome strain is derived. Representative examples of parent strains include, but are not limited to, *E. coli* strains such as K-12 or B, or a strain with a genome sequence substantially identical thereto. The K-12 strain may be MG1655. The nucleotide sequence of the genome of the parental strain may be partially or completely known. The complete genomic sequence of several strains of *E. coli* and other commonly used laboratory microorganisms is known (see, e.g., Blattner et al, *Science,* 277:1453-74, 1997; GenBank Accession No. U00096; Perna et al., *Nature,* 409, 529-533, 2001; Hayashi et al, *DNA Res.,* 8, 11-22, 2001; Welch et al., *Proc. Natl. Acad. Sci., USA* 99:17020-17024, 2002 and GenBank Accession No. AE014075, each of which is incorporated herein by reference.

The nucleic acid sequence of *E. coli* MG1655 (annotated version in56) is set forth in SEQ ID NO: 1 with a total size of 4,639,675 nucleotides or base pairs. The original release of the genomic sequence of *E. coli* MG1655 was annotated version m54 (4,639,221 nucleotides or base pairs). Each gene that was predicted to occur in the original release of the *E. coli* MG1655 genome was assigned a unique numeric identifier beginning with a lowercase "b". The first predicted gene was thrL with b0001 the last gene was lasT with b4403, since the initial release several new genes have been found which were given unauthenticated b-numbers with a suffix of "a" or "0.1" by various groups for example yaaV. Some of these genes were accepted in the most recent annotation (version m56) and have had new b-numbers assigned starting from b4404. Several genes in the m54 version have since been shown to be merged together or split apart caused by sequencing errors these have all been reissued new b-numbers from b4460 to b4500 and the old b-number deaccessioned.

b. Genomic Deletions

The reduced genome strain may be lacking one or more of the nucleic acid regions set forth on Table 1 or sequences substantially identical thereto. Table 1 provides the following annotated features of the genome for *E. coli* MG1655 (annotated version m56) (SEQ ID NO: 1): Column 1 (Type) lists the type of annotated feature (coding sequence (CDS), prophage, rep_origin, repeat region, rRNA, tRNA, misc_RNA or misc_feature); Column 2 (S) lists the reference strand (+: forward, −: complementary); Column 3 (Left) lists the position of the left end of the feature; Column 4 (Right) lists the position of the right end of the feature; Column 5 (Name) lists the name of the feature; and Column 6 (B) lists the Blattner number or b-number of the feature. The reduced genome strain may be MDS41, MDS42, MDS43, MDS44, MDS45, MDS46, MDS47, MDS48, MDS49, MDS50, MDS51, MDS52, MDS53, MDS54, MDS55, MDS56, MDS57, MDS58, MDS59, MDS60 or a strain with a genome substantially identical thereto. The reduced genome strain may also be MDS42recA⁻ or a strain with a genome substantially identical thereto.

One type of nucleic acid sequence that may be deleted includes those that may adversely affect the stability of the organism or of the gene products of that organism. Such elements that give rise to instability include transposable elements, insertion sequences, and other "selfish DNA" elements that may play a role in genome instability. These elements, either intact or defective, may move from one point to another in the genome or other nucleic acid sequences in the cell, such as a vector. These elements may not be important for bacteria survival and growth in a cultured environment. Positions of the IS elements on a genome map of *E. coli* MG1655 (annotated version m54) are shown in FIG. 1 and Table 1 of U.S. Patent Publication No. 20030138937 and International Patent Publication No. WO 2003/070880, the contents of which are incorporated herein by reference. Other nucleic acid sequences associated with genomic instability may also be deleted.

Another type of nucleic acid sequence that may be deleted is the restriction modification system genes and other endogenous nucleases whose products may destroy foreign DNA. These genes may not be important for bacterial survival and growth in culture environments. These genes may also interfere with genetic engineering by destroying vectors introduced into a bacterium, Positions of restriction modification system genes on a genome map of *E. Coli* MG1655 (annotated version m54) are shown in FIG. 1 and Table 1 of U.S. Patent Publication No. 20030138937 and International Patent Publication No. WO 2003/070880, the contents of which are incorporated herein by reference. DNA methylase genes, including heterologous genes, may be added back to the deleted strain so as to optimize the strain for certain uses, for example, eukaryotic methylase genes.

Another type of nucleic acid sequence that may be deleted is the flagella gene family, which may provide motility for bacteria. In cultured environments, bacteria motility may not be important for cell survival and growth and the swimming action may be metabolically very expensive, consuming over 1% of the cellular energy to no benefit. Positions of flagella genes on a genome map of *E. coli* MG1655 (annotated version m54) are shown in FIG. 1 and Table 1 of U.S. Patent Publication No. 20030138937 and International Patent Publication No. WO 2003/070880, the contents of which are incorporated herein by reference.

Another type of nucleic acid sequence that may be deleted is Rhs elements. Rhs elements may share a 3.7 Kb Rhs core, which may be a large homologous repeated region (there may be 5 copies in *E. coli* K-12) that may provide a means for genome rearrangement via homologous recombination. Mhs elements may be accessory elements which largely evolved in some other background and spread to *E. coli* by horizontal exchange after divergence of *E. coli* as a species, Positions of Rhs elements on a genome map of *E. coli* MG1655 (annotated version m54) are shown in FIG. 1 and Table 1 of U.S. Patent Publication No. 20030138937 and International Patent Publication No. WO 2003/070880, the contents of which are incorporated herein by reference.

Another type of nucleic acid sequence that may be deleted is the non-transcribed regions, which may be less important for cell survival and proliferation. Another type of nucleic acid sequence that can be deleted is the hsd regions, which may encode the major restriction modification gene family. Positions of non-transcribed regions and hsd regions on a genome map of *E. coli* MG1655 (annotated version m54) are shown in FIG. 1 and Table 1 of U.S. Patent Publication No. 20030138937 and International Patent Publication No. WO 2003/070880, the contents of which are incorporated herein by reference.

Other types of nucleic acid sequence that may be deleted include prophages, pseudogenes, toxin genes, pathogenicity genes, periplasmic protein genes, membrane protein genes, and bacteriophage receptors, such as [tonA] (FhuA) and/or its complete operon [fhu] ABC which encodes the receptor for the lytic phage T1.

Other types of nucleic acid sequences that may be deleted may be identified by comparing the genome of one bacterial strain to one or more others strains. Nucleic acid sequences that are not present in two or three of the strains are less likely to be functionally essential and thus may be candidates for deletion. After the sequence of *E. coli* K-12 (see Blattner, et al., supra), was compared to the sequence of its close relative O157:H7 (See Perna et al., supra), it was discovered that 22% (K-12) and 46% (O157:H7) of the protein encoding genes may be located on strain-specific islands of from one to about 85 kb inserted randomly into a relatively constant backbone. U.S. Patent Publication No. 20030138937 and International Patent Publication No. WO 2003/070880, the contents of which are incorporated herein by reference, describe the comparison of the genomic sequences of *E. coli* strains O157:H7 EDL933 and K-12 MG1655, which led to the identification and deletion of twelve targets resulting in a bacteria strain with a genome that is about 8% smaller. The bacteria with the reduced genome grew at substantially the same rate as the native parent MG1655 strain.

The DNA sequence of a uropathogenic *E. coli* strain CFT073 H7 (see Welch et al., supra), was recently determined and its sequence was compared to the K-12 (MG1655) and O157:H7. Results show that only about 40% of all coding genes found in any one of the genomes are present in all of the genomes and CFT073, K-12 and 157:H7 are composed of 67%, 43% and 68% strain specific island genes. Based on this information, as much as about 60% of the protein coding sequences may be deleted from *E. coli*. It should be noted that there may be genes essential for growth in one strain that are not required for growth in other strains. In such cases, the gene essential for growth of that strain may not be deleted from the strain or if deleted may be replaced with another gene with a complementary function so as to permit growth of the strain.

Other types of nucleic acid sequences that may be deleted are genes coding periplasmic proteins. Gram-negative bacteria, such as *E. coli*, have two cellular membranes, the inner cell membrane and the outer cell membrane, which are separated by a periplasmic space (PS). Nine known and three putative periplasmic protein genes were successfully deleted in constructing MDS40, without significantly affecting the ability of the organism to grow on minimal medium, as shown in International Patent Publication No. WO 2003/070880, the contents of which are incorporated herein by reference. These mutations affect a range of functions, including amino acid uptake, inorganic metabolism, cell membrane maintenance, sugar metabolism, and adhesion. Eliminating periplasmic proteins may reduce the contaminants in recombinant proteins expressed in the periplasm.

Approximately 85 genes have been deleted that code for known or putative membrane proteins, identified by their signal-peptide sequences. Of these 33 may be involved in flagellar structure or biosynthesis; 9 may be involved in fimbrial structure or biosynthesis; and 13 may be involved in general secretory pathways. The remainder may have a variety of known or putative functions in the cell membranes. Many of these proteins may be processed in the periplasmic space. They have also been deleted in constructing MDS40 without significantly affecting the ability of the organism to grow on minimal medium, as shown in International Patent Publication No. WO 2003/070880, the contents of which are incorporated herein by reference.

By searching for signal peptide-like sequences in annotated MG1655 databases, and cross-relating these with the literature, 181 proteins have been identified which may be resident periplasmic proteins. A number of these proteins have been classified according to function into several groups excluding: adhesion and mobility; nutrient and salt uptake, trace element uptake; environmental sensing; defense and protection; and periplasmic protein secretion and processing. Among the genes or full operons which may be deleted are those coding for sugar and amino acid transport proteins, which may not be needed in defined minimal media say for biopharmaceutical production.

One may test the consequence of deleting one or several genes or other nucleic acid sequences from the genome. For example, after one or several genes or other nucleic acid sequences of the genome have been deleted, one can measure the survival and proliferation rate of the resultant bacteria. Although most of the above-identified genes or other nucleic acid sequences may be deleted without detrimental effect for purpose of producing a desired product, it is possible that the deletion of a specific gene or other nucleic acid sequence may have an unacceptable consequence such as cell death or unacceptable level of reduction in proliferation rate. This possibility exists because of redundancies in gene functions and interactions between biological pathways. Some deletions that are viable in a strain without additional deletions will be deleterious only in combination with other deletions. The possibility exists also because of certain methods used to identify deletion candidates. For example, one method used to identify deletion candidates is to compare two E. coli strains and select genes or other DNA sequences that are not present in both strains. While the majority of these genes and other DNA sequences are not likely to be functionally essential, some of them may be important for a unique strain. Another method used to identify deletion candidates is to identify non-transcribed regions and the possibility exists that certain non-transcribed regions may be important for genome stability.

The consequence of deleting one or several genes or other DNA sequences to be tested depends on the purpose of an application. For example, when high production efficiency is the main concern, which is true for many applications, the effect of deletions on proliferation rate and medium consumption rate can be the consequence tested. In this case, the consequence tested can also be more specific as the production speed quantity and yield per cell of a particular product. When eliminating native protein contamination is the main concern, fewer native proteins and lower native protein levels, or the absence of a specific native protein, can be the consequence tested.

Testing the consequence of deleting a gene or other DNA sequence may be important when little is known about the gene or the DNA sequence. This is another viable method to identify deletion candidates in making a bacterium with a reduced genome. This method is particularly useful when candidates identified by other methods have been deleted and additional candidates are being sought.

When the consequence of deleting a gene or other DNA sequence has an effect on the viability of the bacteria under a set of conditions, one alternative to not deleting the specific gene or other DNA sequence is to determine if there are measures that can mitigate the detrimental effects. For example, if deleting lipopolysaccharide (LPS) genes results in poor survival due to more porous cellular membranes caused by the absence from the cellular membranes of the transmembrane domain of the LPS proteins, culture conditions can be changed to accommodate the more porous cellular membranes so that the bacteria lacking the LPS genes can survive just as well as the bacteria carrying the LPS genes.

c. Manner of Making Deletions

The strains may be made by deleting the nucleic acid sequences using any of the several methods known to those of skill in the art for deleting genomic nucleic acid. The nucleic acid sequences may be deleted from the genome without generating any other mutations at the deletion site and without leaving any inserted nucleic acid behind (scarless deletion). If several sequential deletions are being made from a bacterial genome, it may be important not to leave any inserted nucleic acid sequences behind. Such inserted sequences, if they were left behind, may be candidate sites for undesired recombination events that would delete uncharacterized and perhaps important portions of the remaining genome from the bacteria or cause other unanticipated genome rearrangements with untoward effects.

Representative methods for making deletions in the genome of a bacteria are described in U.S. Patent Publication No. 20030138937 and International Patent Publication No. WO 2003/070880, Posfai, G. et al., *J. Bacteriol.* 179: 4426-4428 (1997), Muyrers, J. P. P, et al., *Nucl. Acids Res.* 27:1555-1557 (1999), Datsenko, K. A. et al., *Proc. Natl. Acad. Sci.* 97:6640-6649 (2000) and Posfai, G. et al., *Nucl. Acids Res.* 27: 4409-4415 (1999), each of which is incorporated herein by reference. The deletion methods may be classified to those that are based on linear DNAs and those that are based on suicide plasmids. The methods disclosed in Muyrers, J. P. P. et al., *Nucl. Acids Res.* 27:1555-1557 (1999) and Datsenko, K. A. et al., *Proc. Natl. Acad. Sci.* 97:6640-6649 (2000) are linear DNA-based methods and the methods disclosed in Posfai, G. et al., *J. Bacteriol.* 179: 4426-4428 (1997) and Posfai, G. et al., *Nucl. Acids Res.* 27: 4409-4415 (1999) are suicide plasmid-based methods.

3. METHODS a. Products

The reduced genome strain may used for the production of desired products, such as recombinant proteins, nucleic acids, therapeutic products, metabolic intermediates and end products. Representative examples of recombinant proteins include, but are not limited to, insulin, interleukins, cytokines, growth hormones, growth factors, erythropoietin, colony stimulating factors, interferon, antibodies and antibody fragments. Representative examples of therapeutic products include, but are not limited to, a vaccine component, a diagnostic product, or a research reagent. Representative examples of metabolic intermediates and end products include, but are not limited to, vanillin, shikimic acid, amino acids, vitamins, organic acids, and the like, and chemical compounds not naturally produced in the bacteria but produced as a result of metabolic pathway engineering or other genetic manipulation (see, e.g., U.S. Pat. Nos. 6,472,16 and 6,372,476, both of which are incorporated herein by reference).

Recombinant proteins may be expressed into the periplasm or cytoplasm. The expression of proteins in the periplasm is routinely used for industrial use and has been reviewed in Hanahan, [*J. Mol. Biol.*], 166:557-80, 1983; Hockney, [*Trends Biotechnol.*], 12:456-632, 1994; and Hannig et al., [*Trends Biotechnol.*], 16:54-60, 1998, each of which is incorporated herein by reference. Recombinant proteins may be produced in the periplasm by expressing fusion proteins in which they are attached to a signal peptide that causes secretion into the periplasmic space. There the signal peptide may be cleaved off by specific signal peptidases.

Constructs useful for periplasmic expression may comprise a first nucleic acid sequence encoding a signal peptide capable of mediating transport of a protein to the periplasmic space operatively linked to a second nucleic acid sequence encoding the desired protein. The signal sequence may be native to the protein being expressed. The protein transported into the periplasmic space may be biologically active. Expression of the recombinant construct may be under the control of an inducible promoter or a promoter that is constitutively expressed in the host strain. The use of inducible promoters may be advantageous when using the Sec system which may be saturable. For example, [lac]-based promoter/repressor, inducible by the non-metabolisable galactose derivative, IPTG, may be used. Such promoters may allow fine tuning of expression and secretion through the Sec system thereby optimizing periplasmic expression.

The recombinant protein may also be co-expressed with chaperones/disulfide-bond forming enzymes which may provide proper folding of the recombinant protein. Nucleic acid sequences useful for periplasmic expression of recombinant protein include, but are not limited to, those described in U.S. Pat. Nos. 5,747,662; 5,578,464; 6,335,178; and 6,022,952; Thomas et al., Mol-Micro[*Mol Micro*], (2001) 39 (1) 47-53; Weiner et al., [*Cell*], (1998) 93, 93-101; and Current Protocols in Molecular Biology[*Current Protocols in Molecular Biology*] (1994) 16.6.1-16.6.14 (Copyright 2000 by John Wiley [et al.] and Sons), each of which is incorporated herein by reference.

b. Amplification

The reduced genome strain may also be used to clone or amplify a nucleic acid. The reduced genome strain may provide a clean, minimal genetic background that may allow the production of high quality nucleic acids. A reduced genome strain lacking selfish DNA elements, such as IS elements, may also allow the cloning of otherwise toxic genes. The reduced genome strain may also be used to produce a library, such as a genomic library.

c. Vaccine

The reduced genome strain may also be used as a vaccine by introducing heterologous genes encoding antigens capable of inducing an immune response in a host that has been inoculated with the vaccine. Reduced genome vaccines may be DNA based vaccines containing a DNA known to be capable of inducing a desired physiological response in a host (i.e., immune response).

The present invention has multiple aspects, illustrated by the following non-limiting examples.

Example 1

Production of MDS40

Reduced genome strain MDS40 was produced as described in International Patent Publication No: WO 2003/070880, which is incorporated herein by reference. Briefly, a series of reduced genome strains (MDS01-MDS40) were produced by making a series of cumulative deletions of nucleic acid sequences from the parental strain *E. coli* MG1655 (annotated version m56) (SEQ ID NO: 1), including those regions shown in Table 2.

Example 2

Production of MDS41

Reduced genome strain MDS41 was produced using methods as described in International Patent Publication No. WO 2003/070880 by deleting the following nucleic acid region from parental strain MDS40, with reference to SEQ ID NO: 1:

| Strain | Type | Coordinates | Name | B | Function |
|---|---|---|---|---|---|
| MDS41 | CDS | 167484 ... 169727 | fhuA | b0150 | outer membrane protein receptor for ferrichrome, colicin M, and phages T1, T5, and phi80 |
| MDS41 | CDS | 169778 ... 170575 | fhuC | b0151 | ATP-binding component of hydroxymate-dependent iron transport |
| MDS41 | CDS | 170575 ... 171465 | fhuD | b0152 | hydroxamate-dependent iron uptake cytoplasmic membrane component |
| MDS41 | CDS | 171462 ... 173444 | fhuB | b0153 | hydroxamate-dependent iron uptake cytoplasmic membrane component |

Example 3

Production of MDS42

Reduced genome strain MDS42 was produced using methods as described in International Patent Publication No. WO 2003/070880 by deleting the following nucleic acid region from parental strain MDS41, with reference to SEQ ID NO: 1:

| Strain | Type | Coordinates | Name | B | Function |
|---|---|---|---|---|---|
| MDS42 | CDS | 3088369 ... 3089076 | endA | b2945 | DNA-specific endonuclease I |

Example 4

Production of MDS42recA⁻

Reduced genome strain MDS42 was produced using methods as described in International Patent Publication No. WO 2003/070880 by deleting the following nucleic acid region from parental strain MDS42, with reference to SEQ ID NO: 1:

| Strain | Type | Coordinates | Name | B | Function |
|---|---|---|---|---|---|
| MDS42recA | CDS | Complement (2820730 . . . 2821791) | recA | b2699 | DNA strand exchange and renaturation DNA-dependent ATPase, DNA- and ATP-dependent coprotease |

Example 5

Production of MDS43

Reduced genome strain MDS43 was produced using methods as described in International Patent Publication No. WO 2003/070880 by deleting the nucleic acid regions shown in Table 3 from parental strain MDS442, with reference to SEQ ID NO: 1.

Example 6

Production of MDS44

Reduced genome strain MDS44 was produced using methods as described in International Patent Publication No. WO 2003/070880 by deleting the following nucleic acid region (also show in Table 4) from parental strain MDS43, with reference to SEQ ID NO: 1:

| Strain | Type | Coordinates | Name | B | Function |
|---|---|---|---|---|---|
| MDS44 | CDS | 2599223 . . . 2599840 | hyfA | b2481 | hydrogenase 4 Fe-S subunit |
| MDS44 | CDS | 2599840 . . . 2601858 | hyfB | b2482 | hydrogenase 4 membrane subunit |
| MDS44 | CDS | 2601869 . . . 2602816 | hyfC | b2483 | hydrogenase 4 membrane subunit |
| MDS44 | CDS | 2602833 . . . 2604272 | hyfD | b2484 | hydrogenase 4 membrane subunit |
| MDS44 | CDS | 2604284 . . . 2604934 | hyfE | b2485 | hydrogenase 4 membrane subunit |
| MDS44 | CDS | 2604939 . . . 2606519 | hyfF | b2486 | hydrogenase 4 membrane subunit |
| MDS44 | CDS | 2606509 . . . 2608176 | hyfG | b2487 | hydrogenase 4 subunit |
| MDS44 | CDS | 2608186 . . . 2608731 | hyfH | b2488 | hydrogenase 4 Fe-S subunit |
| MDS44 | CDS | 2608728 . . . 2609486 | hyfI | b2489 | hydrogenase 4 Fe-S subunit |
| MDS44 | CDS | 2609479 . . . 2609892 | hyfJ | b2490 | hydrogenase 4 component J |
| MDS44 | CDS | 2609922 . . . 2611934 | hyfR | b2491 | putative 2-component regulator interaction with sigma 54 |
| MDS44 | CDS | 2611956 . . . 2612804 | focB | b2492 | probable formate transporter (formate channel 2) |

Example 7

Production of MDS45

Reduced genome strain MDS45 was produced using methods as described in International Patent Publication No. WO 2003/070880 by deleting the following nucleic acid region (also show in Table 5) from parental strain MDS44, with reference to SEQ ID NO: 1:

| Strain | Type | Coordinates | Name | B | Function |
|---|---|---|---|---|---|
| MDS45 | CDS | 2318065 . . . 2319891 | atoS | b2219 | sensor protein AtoS for response regulator AtoC |
| MDS45 | CDS | 2319888 . . . 2321273 | atoC | b2220 | response regulator of ato, ornithine decarboxylase antizyme (sensor ATOS) |
| MDS45 | CDS | 2321469 . . . 2322131 | atoD | b2221 | acetyl-CoA: acetoacetyl-CoA transferase alpha subunit |
| MDS45 | CDS | 2322131 . . . 2322781 | atoA | b2222 | acetyl-CoA: acetoacetyl-CoA transferase beta subunit |
| MDS45 | CDS | 2322778 . . . 2324100 | atoE | b2223 | short chain fatty acid transporter |
| MDS45 | CDS | 2324131 . . . 2325315 | atoB | b2224 | acetyl-CoA acetyltransferase |
| MDS45 | CDS | complement(2325389 . . . 2326165) | yfaP | b2225 | orf, hypothetical protein |
| MDS45 | CDS | complement(2326170 . . . 2327819) | yfaQ | b2226 | orf, hypothetical protein |
| MDS45 | CDS | complement(2327820 . . . 2328305) | yfaS_2 | b2227 | orf, hypothetical protein |
| MDS45 | pseudogene | complement(2327820 . . . 2332424) | yfaS | b4500 | pseudogene |
| MDS45 | CDS | complement(2328321 . . . 2332424) | yfaS_1 | b2228 | putative membrane protein |
| MDS45 | CDS | complement(2332358 . . . 2332981) | yfaT | b2229 | orf, hypothetical protein |
| MDS45 | CDS | complement(2332978 . . . 2334666) | yfaA | b2230 | orf, hypothetical protein |

Example 8

Production of MDS46

Reduced genome strain MDS46 was produced using methods as described in International Patent Publication No. WO 2003/070880 by deleting the following nucleic acid region (also show in Table 6) from parental strain MDS45, with reference to SEQ ID NO: 1:

| Strain | Type | Coordinates | Name | B | Function |
|---|---|---|---|---|---|
| MDS46 | CDS | 3886458 . . . 3886532 | tnaL | b3707 | tryptophanase leader peptide |
| MDS46 | CDS | 3886753 . . . 3888168 | tnaA | b3708 | tryptophanase |
| MDS46 | CDS | 3888259 . . . 3889506 | tnaB | b3709 | low affinity tryptophan permease |
| MDS46 | CDS | 3889638 . . . 3890813 | yidY | b3710 | putative transport protein |
| MDS46 | CDS | 3890788 . . . 3891747 | yidZ | b3711 | putative transcriptional regulator LYSR-type |
| MDS46 | CDS | 3891892 . . . 3892653 | yieE | b3712 | orf, hypothetical protein |
| MDS46 | CDS | 3892675 . . . 3893241 | yieF | b3713 | orf, hypothetical protein |
| MDS46 | CDS | complement(3893295 . . . 3894632) | yieG | b3714 | putative membrane/transport protein |
| MDS46 | CDS | 3894797 . . . 3895462 | yieH | b3715 | putative phosphatase |
| MDS46 | CDS | 3895529 . . . 3895996 | yieI | b3716 | orf, hypothetical protein |
| MDS46 | CDS | 3896045 . . . 3896632 | yieJ | b3717 | orf, hypothetical protein |
| MDS46 | CDS | complement(3896694 . . . 3897416) | yieK | b3718 | pyrimidine-specific nucleoside hydrolase |
| MDS46 | CDS | complement(3897431 . . . 3898627) | yieL | b3719 | putative xylanase |
| MDS46 | CDS | complement(3898627 . . . 3900243) | yieC | b3720 | putative receptor protein |
| MDS46 | CDS | complement(3900312 . . . 3901724) | bglB | b3721 | phospho-beta-glucosidase B; cryptic |
| MDS46 | CDS | complement(3901743 . . . 3903620) | bglF | b3722 | PTS system beta-glucosides, enzyme II, cryptic |
| MDS46 | CDS | complement(3903754 . . . 3904590) | bglG | b3723 | positive regulation of bgl operon |

Example 9

Production of MDS47

Reduced genome strain MDS47 was produced using methods as described in International Patent Publication No. WO 2003/070880 by deleting the following nucleic acid region (also show in Table 7) from parental strain MDS46, with reference to SEQ ID NO: 1:

| Strain | Type | Coordinates | Name | B | Function |
|---|---|---|---|---|---|
| MDS47 | CDS | complement(674793 . . . 675770) | ybeQ | b0644 | orf, hypothetical protein |
| MDS47 | CDS | 675934 . . . 676641 | ybeR | b0645 | orf, hypothetical protein |
| MDS47 | CDS | 676638 . . . 678065 | ybeS | b0646 | putative enzyme of polynucleotide modification |
| MDS47 | CDS | complement(678075 . . . 678629) | ybeT | b0647 | orf, hypothetical protein |
| MDS47 | CDS | 678731 . . . 679438 | ybeU | b0648 | putative tRNA ligase |
| MDS47 | CDS | 679435 . . . 680886 | ybeV | b0649 | orf, hypothetical protein |
| MDS47 | CDS | complement(680946 . . . 682616) | hscC | b0650 | putative heatshock protein (Hsp70 family) |

Example 10

Production of MDS48

Reduced genome strain MDS48 was produced using methods as described in International Patent Publication No. WO 2003/070880 by deleting the following nucleic acid region (also show in Table 8) from parental strain MDS47, with reference to SEQ ID NO: 1:

| Strain | Type | Coordinates | Name | B | Function |
|---|---|---|---|---|---|
| MDS48 | CDS | complement(4295242 . . . 4297389) | fdhF | b4079 | selenopolypeptide subunit of formate dehydrogenase H |
| MDS48 | CDS | complement(4297587 . . . 4299053) | yjcP | b4080 | putative enzyme |
| MDS48 | CDS | complement(4299050 . . . 4301101) | yjcQ | b4081 | putative enzyme |
| MDS48 | CDS | complement(4301101 . . . 4302132) | yjcR | b4082 | putative membrane protein |
| MDS48 | CDS | complement(4302635 . . . 4304620) | yjcS | b4083 | orf, hypothetical protein |
| MDS48 | CDS | complement(4304893 . . . 4305822) | alsK | b4084 | putative D-allose kinase |
| MDS48 | CDS | complement(4305806 . . . 4306501) | alsE | b4085 | allulose-6-phosphate 3-epimerase |
| MDS48 | CDS | complement(4306512 . . . 4307492) | alsE | b4086 | D-allose ABC transporter |
| MDS48 | CDS | complement(4307471 . . . 4309003) | alsA | b4087 | D-allose ABC transporter |
| MDS48 | CDS | complement(4309130 . . . 4310065) | alsB | b4088 | D-allose ABC transporter |
| MDS48 | CDS | complement(4310124 . . . 4311014) | rpiR | b4089 | transcriptional repressor of rpiB expression |
| MDS48 | CDS | 4311373 . . . 4311822 | rpiB | b4090 | ribose 5-phosphate isomerase B |
| MDS48 | CDS | 4311891 . . . 4312220 | yjdP | b4487 | conserved hypothetical protein |
| MDS48 | CDS | complement(4312367 . . . 4313125) | phnP | b4092 | phosphonate metabolism |
| MDS48 | CDS | complement(4313127 . . . 4313561) | phnO | b4093 | putative regulator, phn operon |
| MDS48 | CDS | complement(4313548 . . . 4314105) | phnN | b4094 | ATP-binding component of phosphonate transport |
| MDS48 | CDS | complement(4314105 . . . 4315241) | phnM | b4095 | phosphonate metabolism |
| MDS48 | CDS | complement(4315238 . . . 4315918) | phnL | b4096 | ATP-binding component of phosphonate transport |
| MDS48 | CDS | complement(4316029 . . . 4316787) | phnK | b4097 | ATP-binding component of phosphonate transport |
| MDS48 | CDS | complement(4316784 . . . 4317629) | phnJ | b4098 | phosphonate metabolism |
| MDS48 | CDS | complement(4317622 . . . 4318686) | phnI | b4099 | phosphonate metabolism |
| MDS48 | CDS | complement(4318686 . . . 4319270) | phnH | b4100 | phosphonate metabolism |
| MDS48 | CDS | complement(4319267 . . . 4319719) | phnG | b4101 | phosphonate metabolism |
| MDS48 | CDS | complement(4319720 . . . 4320445) | phnF | b4102 | putative transcriptional regulator |
| MDS48 | CDS | complement(4320466 . . . 4320834) | phnE_2 | b4103 | orf, hypothetical protein |
| MDS48 | CDS | complement(4320684 . . . 4321304) | phnE | b4104 | membrane channel protein component of Pn transporter |
| MDS48 | CDS | complement(4321359 . . . 4322375) | phnD | b4105 | periplasmic binding protein component of Pn transporter |
| MDS48 | CDS | complement(4322400 . . . 4323188) | phnC | b4106 | ATP-binding component of phosphonate transport |

Example 11

Production of MDS49

Reduced genome strain MDS49 was produced using methods as described in International Patent Publication No. WO 2003/070880 by deleting the following nucleic acid region (also show in Table 9) from parental strain MDS48, with reference to SEQ ID NO: 1:

| Strain | Type | Coordinates | Name | B | Function |
|---|---|---|---|---|---|
| MDS49 | CDS | complement(764376 . . . 765098) | farR | b0730 | transcriptional regulator of succinyl-CoA synthetase operon |
| MDS49 | CDS | 765207 . . . 767183 | hrsA | b0731 | protein modification enzyme, induction of ompC |
| MDS49 | CDS | 767201 . . . 769834 | ybgG | b0732 | putative sugar hydrolase |

Example 12

Production of MDS50

Reduced genome strain MDS450 was produced using methods as described in International Patent Publication No. WO 2003/070880 by deleting the following nucleic acid region (also show in Table 10) from parental strain MDS49, with reference to SEQ ID NO: 1:

| Strain | Type | Coordinates | Name | B | Function |
|---|---|---|---|---|---|
| MDS50 | CDS | 3737728...3738981 | avtA | b3572 | alanine-alpha-ketoisovalerate (or valine-pyruvate) transaminase, transaminase C |
| MDS50 | CDS | complement(3739132...3739605) | yiaI | b3573 | orf, hypothetical protein |
| MDS50 | CDS | complement(3739707...3740555) | yiaJ | b3574 | transcriptional repressor of the yiaK-S operon. |
| MDS50 | CDS | 3740756...3741754 | yiaK | b3575 | putative dehydrogenase |
| MDS50 | CDS | 3741766...3742233 | yiaL | b3576 | putative lipase |
| MDS50 | CDS | 3742351...3742824 | yiaM | b3577 | orf, hypothetical protein |
| MDS50 | CDS | 3742827...3744104 | yiaN | b3578 | putative membrane protein |
| MDS50 | CDS | 3744117...3745103 | yiaO | b3579 | putative solute-binding transport protein |
| MDS50 | CDS | 3745107...3746603 | lyxK | b3580 | L-xylulose kinase, cryptic |
| MDS50 | CDS | 3746600...3747262 | sgbH | b3581 | probable 3-hexulose 6-phosphate synthase |
| MDS50 | CDS | 3747255...3748115 | sgbU | b3582 | putative 3-hexulose-6-phosphate isomerase |
| MDS50 | CDS | 3748109...3748804 | sgbE | b3583 | L-ribulose-5-phosphate 4-epimerase |
| MDS50 | CDS | complement(3749151...3749891) | yiaT | b3584 | putative outer membrane protein |
| MDS50 | CDS | 3750015...3750989 | yiaU | b3585 | putative transcriptional regulator LYSR-type |
| MDS50 | CDS | complement(3750986...3752122) | yiaV | b3586 | putative membrane protein |
| MDS50 | CDS | complement(3752128...3752451) | yiaW | b3587 | orf, hypothetical protein |

Example 13

Production of MDS51

Reduced genome strain MDS51 was produced using methods as described in International Patent Publication No. WO 2003/070880 by deleting the following nucleic acid region (also show in Table 11) from parental strain MDS50, with reference to SEQ ID NO: 1:

| Strain | Type | Coordinates | Name | B | Function |
|---|---|---|---|---|---|
| MDS51 | CDS | 1727111...1731727 | lhr | b1653 | member of ATP-dependent helicase superfamily II |

Example 14

Production of MDS52

Reduced genome strain MDS52 was produced using methods as described in International Patent Publication No. WO 2003/070880 by deleting the following nucleic acid region (also show in Table 12) from parental strain MDS51, with reference to SEQ ID NO: 1:

| Strain | Type | Coordinates | Name | B | Function |
|---|---|---|---|---|---|
| MD52 | CDS | complement (2858489...2859286) | ygbI | b2735 | putative DEOR-type transcriptional regulator |
| MD52 | CDS | 2859452...2860360 | ygbJ | b2736 | putative dehydrogenase |
| MD52 | CDS | 2860357...2861523 | ygbK | b2737 | orf, hypothetical protein |
| MD52 | CDS | 2861615...2862253 | ygbL | b2738 | putative epimerase/aldolase |
| MD52 | CDS | 2862258...2863034 | ygbM | b2739 | orf, hypothetical protein |
| MD52 | CDS | 2863123...2864487 | ygbN | b2740 | putative transport protein |

Example 15

Production of MDS53

Reduced genome strain MDS53 was produced using methods as described in International Patent Publication No. WO 2003/070880 by deleting the following nucleic acid region (also show in Table 13) from parental strain MDS52, with reference to SEQ ID NO: 1:

| Strain | Type | Coordinates | Name | B | Function |
|---|---|---|---|---|---|
| MDS53 | CDS | complement(2519615 ... 2520499) | xapR | b2405 | regulator for xapA |
| MDS53 | CDS | complement(2520751 ... 2522007) | xapB | b2406 | xanthosine permease |
| MDS53 | CDS | complement(2522067 ... 2522900) | xapA | b2407 | xanthosine phosphorylase |

Example 16

Production of MDS54

Reduced genome strain M4DS54 was produced using methods as described in International Patent Publication No. WO 2003/070880 by deleting the following nucleic acid region (also show in Table 14) from parental strain MDS53, with reference to SEQ ID NO: 1:

| Strain | Type | Coordinates | Name | B | Function |
|---|---|---|---|---|---|
| MDS54 | CDS | 4085025 ... 4086080 | yiiG | b3896 | orf, hypothetical protein |
| MDS54 | CDS | complement(4086130 ... 4087878) | frvR | b3897 | putative frv operon regulatory protein |
| MDS54 | CDS | complement(4087878 ... 4088948) | frvX | b3898 | frv operon protein |
| MDS54 | CDS | complement(4088938 ... 4090389) | frvB | b3899 | PTS system, fructose-like enzyme IIBC component |
| MDS54 | CDS | complement(4090400 ... 4090846) | frvA | b3900 | PTS system, fructose-specific IIA component |

Example 17

Production of MDS55

Reduced genome strain MDS55 was produced using methods as described in International Patent Publication No. WO 2003/070880 by deleting the following nucleic acid region (also show in Table 15) from parental strain MDS54, with reference to SEQ ID NO: 1:

| Strain | Type | Coordinates | Name | B | Function |
|---|---|---|---|---|---|
| MDS55 | CDS | complement(1252308 ... 1255175) | yogV | b1202 | putative adhesion and penetration protein |

Example 18

Production of MDS56

Reduced genome strain MDS56 was produced using methods as described in International Patent Publication No. WO 2003/070880 by deleting the following nucleic acid region (also show in Table 16) from parental strain MDS55, with reference to SEQ ID NO: 1:

| Strain | Type | Coordinates | Name | B | Function |
|---|---|---|---|---|---|
| MDS56 | CDS | complement(4486584...4488086) | yjgR | b4263 | orf, hypothetical protein |
| MDS56 | CDS | complement(4488164...4489162) | idnR | b4264 | L-idonate transcriptional regulator |
| MDS56 | CDS | complement(4489229...4490548) | idnT | b4265 | L-idonate transporter |
| MDS56 | CDS | complement(4490610...4491374) | idnO | b4266 | 5-keto-D-gluconate 5-reductase |
| MDS56 | CDS | complement(4491398...4492429) | idnD | b4267 | L-idonate dehydrogenase |
| MDS56 | CDS | 4492646...4493209 | idnK | b4268 | gluconate kinase |

Example 19

Production of MDS57

Reduced genome strain MDS57 was produced using methods as described in International Patent Publication No. WO 2003/070880 by deleting the following nucleic acid region (also show in Table 17) from parental strain MDS56, with reference to SEQ ID NO: 1:

| Strain | Type | Coordinates | Name | B | Function |
|---|---|---|---|---|---|
| MDS57 | CDS | complement(643420...644226) | rna | b0611 | RNase I, cleaves phosphodiester bond between any two nucleotides |

Example 20

Production of MDS58

Reduced genome strain MDS58 was produced using methods as described in International Patent Publication No. WO 2003/070880 by deleting the following nucleic acid region (also show in Table 18) from parental strain MDS57, with reference to SEQ ID NO: 1:

| Strain | Type | Coordinates | Name | B | Function |
|---|---|---|---|---|---|
| MDS58 | CDS | complement(2474716...2475651) | dsdC | b2364 | D-serine dehydratase (deaminase) transcriptional activator |
| MDS58 | CDS | 2475869...2477206 | dsdX | b2365 | transport system permease (serine) |
| MDS58 | CDS | 2477224...2478552 | dsdA | b2366 | D-serine dehydratase (deaminase) |

Example 21

Production of MDS59

Reduced genome strain MDS59 was produced using methods as described in International Patent Publication No. WO 2003/070880 by deleting the following nucleic acid region (also show in Table 19) from parental strain N4DS58, with reference to SEQ ID NO: 1:

| Strain | Type | Coordinates | Name | B | Function |
|---|---|---|---|---|---|
| MDS59 | CDS | 879950 . . . 881152 | dacC | b0839 | D-alanyl-D-alanine carboxypeptidase penicillin-binding protein 6 |

Example 22

Production of MDS60

Reduced genome strain MDS60 was produced using methods as described in International Patent Publication No. WO 2003/070880 by deleting the following nucleic acid region (also show in Table 20) from parental strain MDS59, with reference to SEQ ID NO: 1:

| Strain | Type | Coordinates | Name | B | Function |
|---|---|---|---|---|---|
| MDS60 | CDS | complement(513625 . . . 514080) | ybbJ | b0488 | orf, hypothetical protein |
| MDS60 | CDS | complement(514080 . . . 514997) | ybbK | b0489 | putative protease |
| MDS60 | CDS | 515143 . . . 515820 | ybbL | b0490 | putative ATP-binding component of a transport system |
| MDS60 | CDS | 515807 . . . 516586 | ybbM | b0491 | putative metal resistance protein |
| MDS60 | CDS | complement(516649 . . . 517503) | ybbN | b0492 | putative thioredoxin-like protein |
| MDS60 | CDS | complement(517564 . . . 518373) | ybbO | b0493 | putative oxidoreductase |
| MDS60 | CDS | complement(518363 . . . 518989) | tesA | b0494 | acyl-CoA thioesterase I; also functions as protease I |
| MDS60 | CDS | 518957 . . . 519643 | ybbA | b0495 | putative ATP-binding component of a transport system |
| MDS60 | CDS | 519640 . . . 522054 | ybbP | b0496 | putative oxidoreductase |
| MDS60 | CDS | 522485 . . . 526765 | rhsD | b0497 | rhsD protein in rhs element |
| MDS60 | CDS | 526805 . . . 527173 | ybbC | b0498 | orf, hypothetical protein |
| MDS60 | CDS | 527173 . . . 527883 | ylbH | b0499 | orf, hypothetical protein |
| MDS60 | CDS | 527864 . . . 528124 | ybbD | b0500 | orf, hypothetical protein |
| MDS60 | CDS | complement(528869 . . . 529240) | ylbJ | b0502 | orf, hypothetical protein |

Example 23

Growth Rates of Reduced Genome Strains

Strains MDS41, MDS42, MDS43, MDS44, MDS45, MDS46, MDS47, MDS48, MDS49, MDS50, MDS51, MDS52, MDS53, MDS54, MDS55, MDS56, MDS57, MDS58, MDS59 and MDS60 were characterized for growth on standard microbiological media. Each of the MDS strains can be grown to high cell densities in fed-batch fermentations on minimal medium. In addition, the growth rates were essentially unchanged for each strain relative to the parental strain MG1655.

Figure 2:
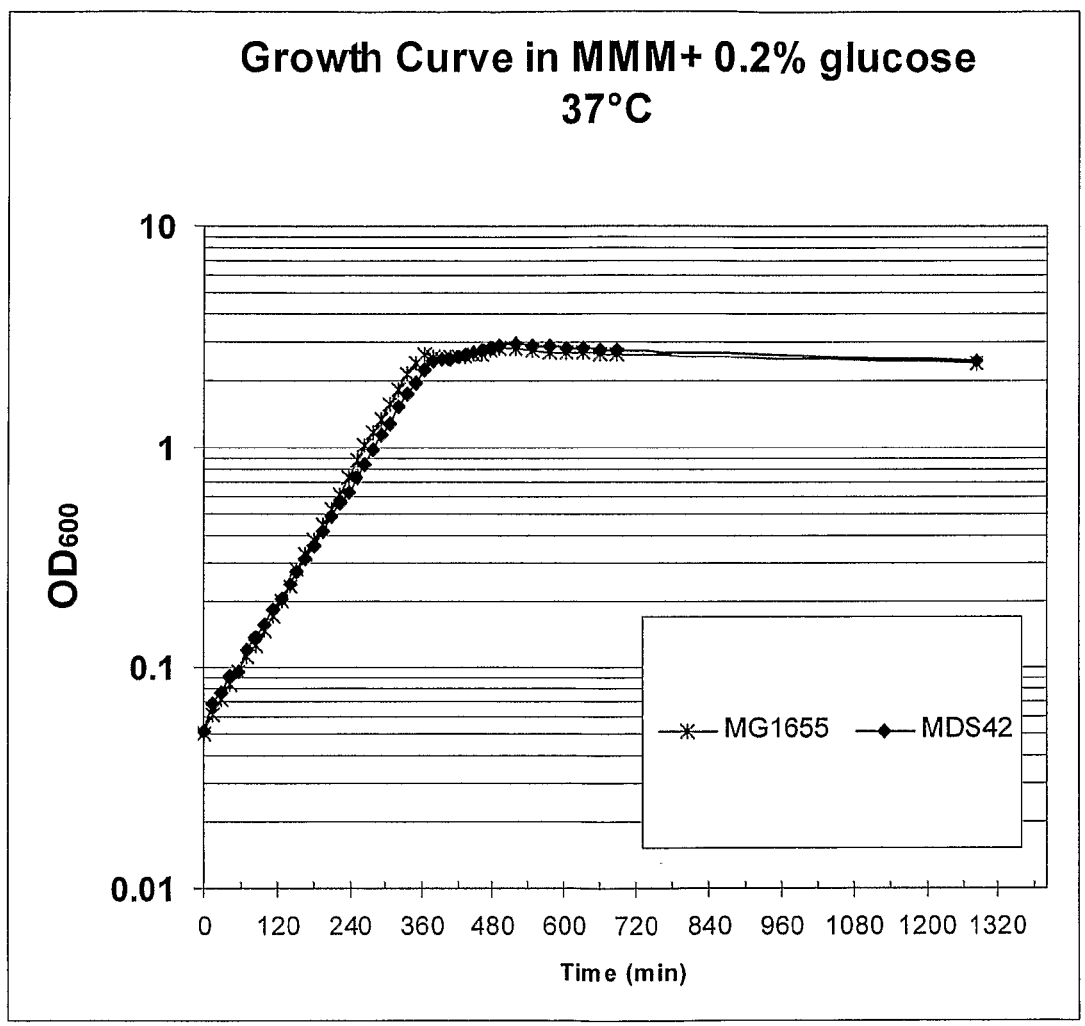
FIG. 2 shows a comparison of the growth rate of MG1655 and MDS42 in MOPS minimal medium at 37° C.

FIG. 2 shows a representative comparison of the growth rate of MG1655 and MDS42 in MOPS minimal medium at 37° C. Doubling time was obtained by measuring $OD_{600}$ of cultures grown in baffled flasks at 37° C. The log linear portion of the growth curve was used to calculate the average doubling times and standard deviation from six replicates on the plate. The doubling time of MG1655 was 61.3 minutes compared to a doubling time of 69.07 minutes for MDS42.

Example 24

Transformation Efficiency of Reduced Genome Strains

Strain MDS42 was compared to MG1655 for transformation efficiency. Cells were grown under standard growth conditions to optical density of 0.5 at 600 nm. Cell cultures were then centrifuged, cell pellets were washed several times with water and finally resuspended in water. Approximately 25 ng of either pUC19 or BAC DNA was added to approximately 100 µl of the cell suspension and subjected to electroporation using standard electroporation protocol, e.g., 1.8 kV and resistance of 150 ohms in a 0.1 cm electroporation cuvette using an Invitrogen Electroporator II™ device. As shown below, MDS42 has a substantially higher transformation efficiency compared to MG1655.

| | Electroporation Efficiency (transformants/µg DNA) | |
|---|---|---|
| Strain | pUC19 (2.6 kb) | BAC (150 kb) |
| MDS42 | $4.0 \times 10^9$ | $8.6 \times 10^6$ |
| MG1655 | $3.0 \times 10^7$ | $3.3 \times 10^6$ |

Example 25

Protein Expression in Reduced Genome Strains

Figure 3:
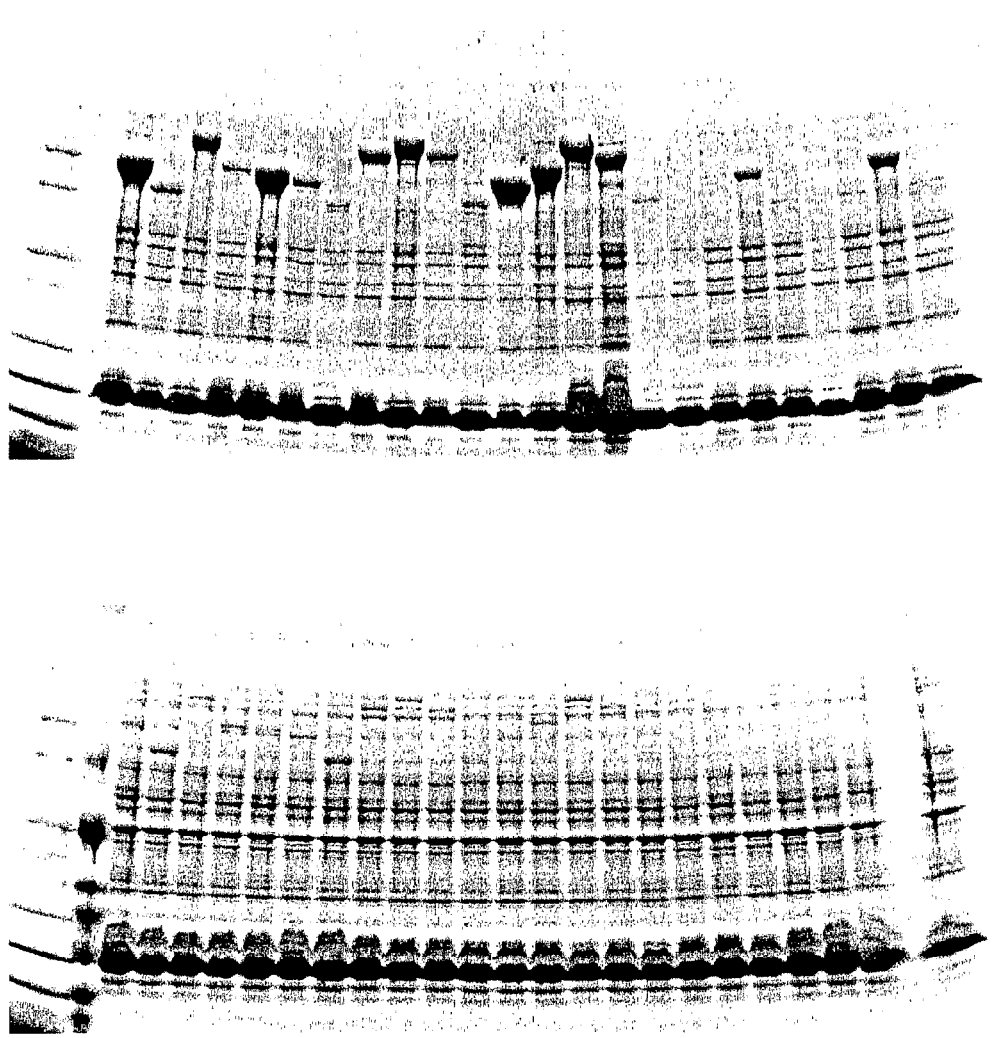
FIG. 3 shows a comparison of the expression of chloramphenicol acetyl transferase (CAT) in MDS42 (top) and MG1655 (bottom).

FIG. 3 shows that expression of recombinant proteins was similar for the MDS and MG1655 strains based on expression of the model protein chloramphenicol acetyl transferase (CAT).

Example 26

DNA Production in Reduced Genome Strains

The results below show that the reduced genome strains are able to produce recombinant DNA with yields higher than the native parental strain and other commercial strains.

| | DNA Yields (ng/ml) | |
|---|---|---|
| Strain | pUC19 | PACYC184 |
| MDS42 | 1305.6 | 487.8 |
| MG1655 | 991.2 | 582.6 |
| DH10B | 1228.8 | 195.6 |

| | DNA Yields (mg/OD$_{600}$) | |
|---|---|---|
| Strain | Plasmid A | Plasmid B |
| MDS42recA$^-$ | 4.97 | 6.26 |
| DH10B | 3.05 | 0.26 |

Example 27

DNA Stability in Reduced Genome Strains

Figure 4:
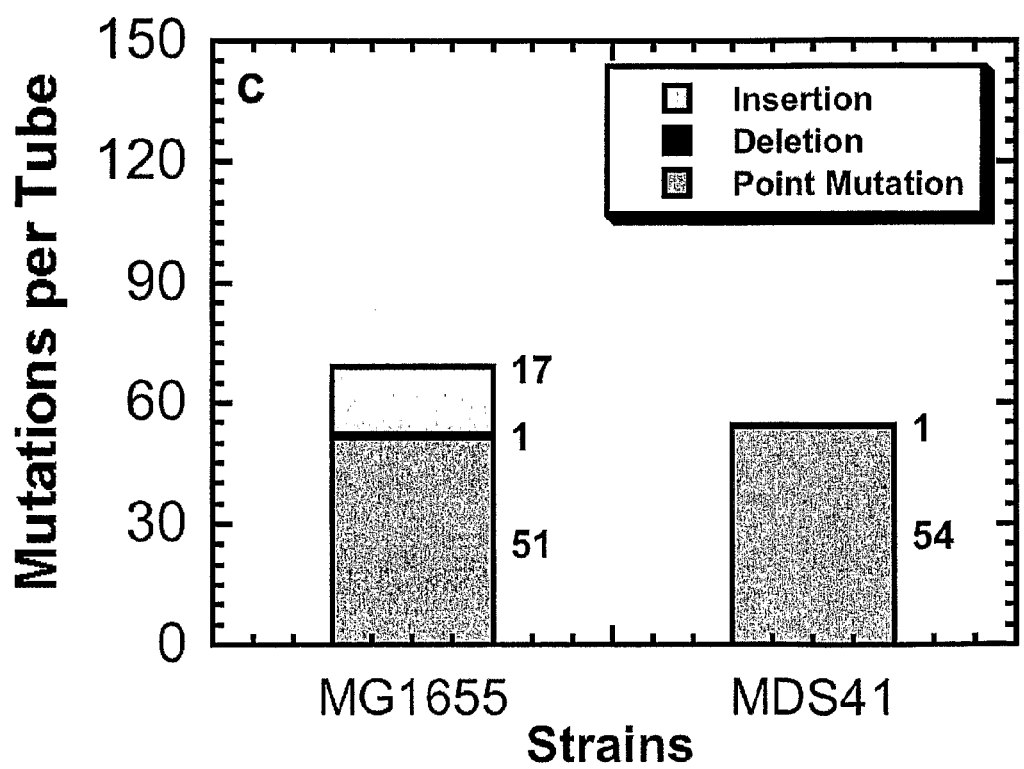
FIG. 4 shows a comparison of the mutation rates in MDS41 and MG1655 based on cyca mutations causing D-cycloserine resistance.

FIG. 4 indicates that the measured frequency of mutation by IS hopping dropped to zero in the reduced genome strains. Interestingly, the frequency of IS insertion events increased by 2.5-fold when CAT was over expressed in MG1655. This indicates that the over-expression of recombinant proteins may induce IS transposition. The reduced genome strains may therefore be a more stable host for protein production.

Example 28

DNA Quality in Reduced Genome Strains

Figure 5:
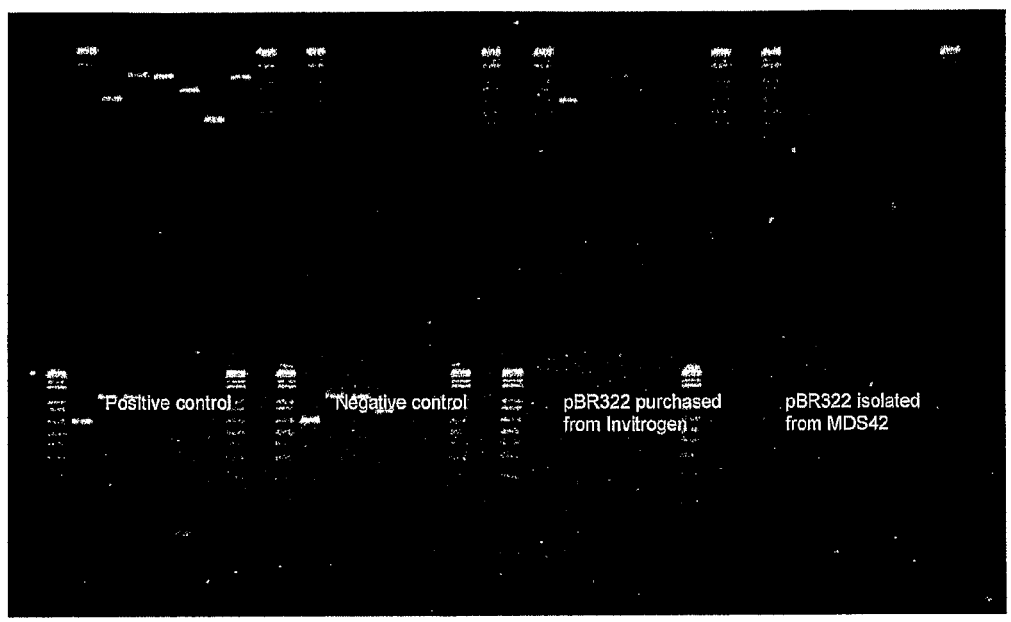
FIG. 5 shows the PCR detection of IS elements in various DNA preparations. Each panel is loaded in the same order: 1 kb+ marker, IS, IS2, IS3, IS5, IS10, IS186, 1 kb+ marker, for (1) Positive Control, (2) Negative Control, (3) pBR322 from Invitrogen, and (4) pBR322 produced in MDS42.

To test the quality of DNA obtained from the reduced genome strains, pBR322 isolated from MDS42 and commercially obtained pBR322 were tested for the presence of IS elements by PCR. FIG. 5 indicates that recombinant DNA of high quality may be obtained from the reduced genome strains.

Example 29

Cloning of Difficult to Clone Sequence in Reduced Genome Strains

Figure 6:
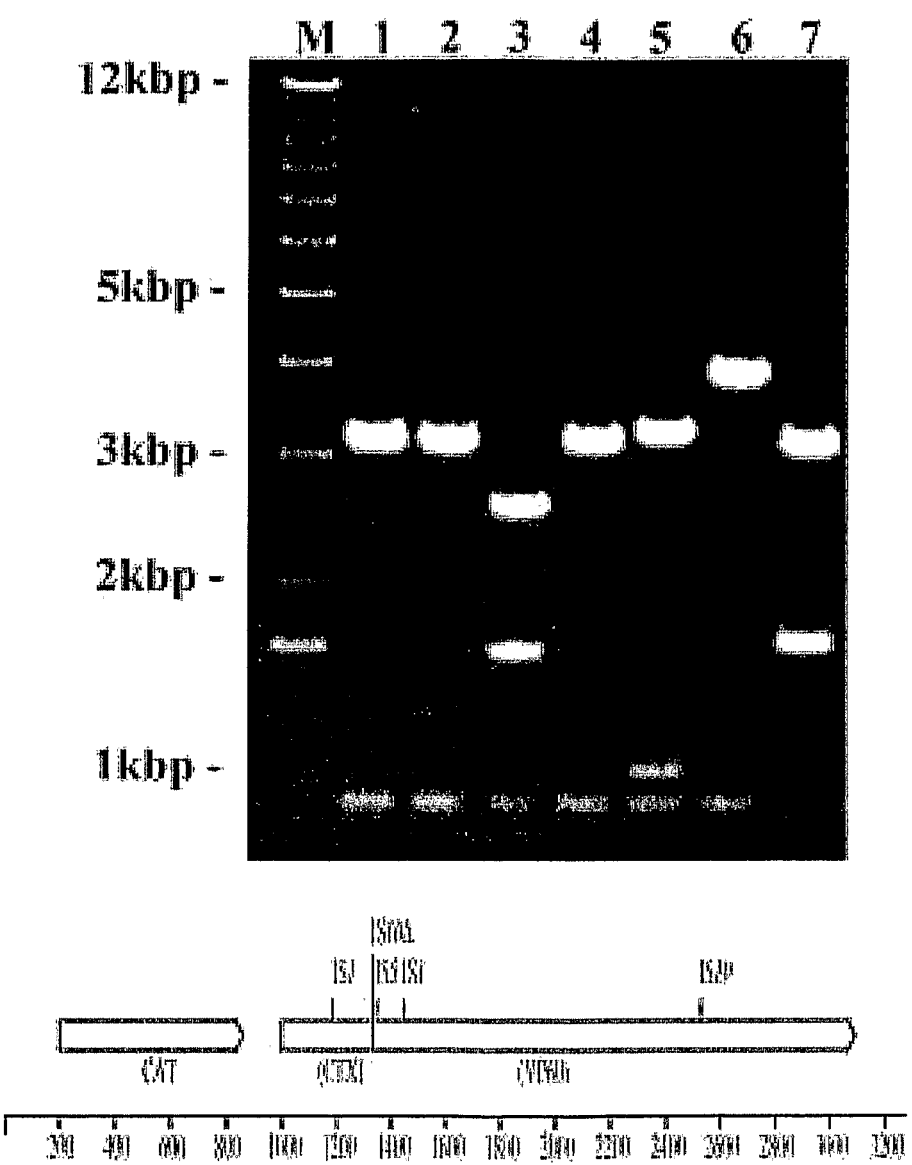
FIG. 6 shows the restriction pattern of pCTXVP60 propagated in various strains: (M) molecular weight marker, 1 kbp ladder; (1) MDS41, no insertion; (2) MDS42, no insertion; (3) DH10B, IS10 insertion; (4) DH10B, IS10 insertion/deletion; (5) C600, IS5 insertion; (6) C600, IS1 insertion; and (7) C600, IS1 insertion. Below the gel, the relative positions of the IS insertions in the CTXVP60 reading frame are diagrammed.

MDS42 was used to prepare pCTXVP60. The plasmid DNA was then propagated in various hosts, isolated, then digested with NcoI and EcoRI. FIG. 6 shows a representative restriction pattern. The fragments were then purified and sequenced. MDS41 (lane 1) and MDS42 (lane 2) did not contain an insertion. DH10B contained an IS1 insertion (lane 3) and also an IS10 insertion/deletion (lane 4). C600 contained an IS5 insertion (lane 5), an IS1 insertion (lanes 6 and 7). This shows that the reduced genome strains may be used to clone sequences that would be difficult to clone (e.g., toxic genes) in other strains.

TABLE 1

| Type | S | Left | Right | Name | B |
|---|---|---|---|---|---|
| CDS | + | 190 | 255 | thrL | b0001 |
| CDS | + | 337 | 2799 | thrA | b0002 |
| CDS | + | 2801 | 3733 | thrB | b0003 |
| CDS | + | 3734 | 5020 | thrC | b0004 |
| CDS | + | 5234 | 5530 | yaaX | b0005 |
| CDS | − | 5683 | 6459 | yaaA | b0006 |
| CDS | − | 6529 | 7959 | yaaJ | b0007 |
| CDS | + | 8238 | 9191 | talB | b0008 |
| CDS | + | 9306 | 9893 | mog | b0009 |
| CDS | − | 9928 | 10494 | yaaH | b0010 |
| CDS | − | 10643 | 11356 | yaaW | b0011 |
| CDS | + | 10830 | 11315 | htgA | b0012 |
| CDS | − | 11382 | 11786 | yaaI | b0013 |
| CDS | + | 12163 | 14079 | dnaK | b0014 |
| CDS | + | 14168 | 15298 | dnaJ | b0015 |
| repeat_region | + | 15388 | 16730 | | |
| CDS | + | 15445 | 16557 | yi81_1 | b0016 |
| CDS | − | 15869 | 16177 | yi82_1 | b0017 |
| CDS | − | 16751 | 16960 | mokC | b0018 |
| CDS | + | 17489 | 18655 | nhaA | b0019 |
| CDS | + | 18715 | 19620 | nhaR | b0020 |
| repeat_region | − | 19796 | 20553 | | |
| CDS | − | 19811 | 20314 | insB_1 | b0021 |
| CDS | − | 20233 | 20508 | insA_1 | b0022 |
| CDS | − | 20815 | 21078 | rpsT | b0023 |
| CDS | + | 21181 | 21399 | yaaY | b0024 |
| CDS | + | 21407 | 22348 | ribF | b0025 |
| CDS | + | 22391 | 25207 | ileS | b0026 |
| CDS | + | 25207 | 25701 | lspA | b0027 |
| CDS | + | 25826 | 26275 | fkpB | b0028 |
| CDS | + | 26277 | 27227 | ispH | b0029 |
| CDS | + | 27293 | 28207 | rihC | b0030 |
| CDS | + | 28374 | 29195 | dapB | b0031 |
| CDS | + | 29651 | 30799 | carA | b0032 |
| CDS | + | 30817 | 34038 | carB | b0033 |
| CDS | + | 34300 | 34695 | caiF | b0034 |
| CDS | − | 34781 | 35371 | caiE | b0035 |
| CDS | − | 35377 | 36270 | caiD | b0036 |
| CDS | − | 36271 | 37839 | caiC | b0037 |
| CDS | − | 37898 | 39115 | caiB | b0038 |
| CDS | − | 39244 | 40386 | caiA | b0039 |
| CDS | − | 40417 | 41931 | caiT | b0040 |
| CDS | + | 42403 | 43173 | fixA | b0041 |
| CDS | + | 43188 | 44129 | fixB | b0042 |
| CDS | + | 44180 | 45466 | fixC | b0043 |
| CDS | + | 45463 | 45750 | fixX | b0044 |
| CDS | + | 45807 | 47138 | yaaU | b0045 |
| CDS | + | 47246 | 47776 | yabF | b0046 |
| CDS | + | 47769 | 49631 | kefC | b0047 |
| CDS | + | 49823 | 50302 | folA | b0048 |
| CDS | − | 50380 | 51222 | apaH | b0049 |
| CDS | − | 51229 | 51606 | apaG | b0050 |
| CDS | − | 51609 | 52430 | ksgA | b0051 |
| CDS | − | 52427 | 53416 | pdxA | b0052 |
| CDS | − | 53416 | 54702 | surA | b0053 |
| CDS | − | 54755 | 57109 | imp | b0054 |
| CDS | + | 57364 | 58179 | djlA | b0055 |
| CDS | + | 58474 | 59124 | yabP | b0056 |
| CDS | + | 59121 | 59279 | yabQ | b0057 |
| CDS | − | 59687 | 60346 | rluA | b0058 |
| CDS | − | 60358 | 63264 | hepA | b0059 |
| CDS | − | 63429 | 65780 | polB | b0060 |
| CDS | − | 65855 | 66550 | araD | b0061 |
| CDS | − | 66835 | 68337 | araA | b0062 |
| CDS | − | 68348 | 70048 | araB | b0063 |
| CDS | + | 70387 | 71265 | araC | b0064 |
| CDS | + | 71351 | 72115 | yabI | b0065 |

TABLE 1-continued

| Type | S | Left | Right | Name | B |
|------|---|------|-------|------|---|
| CDS | − | 72229 | 72927 | yabJ | b0066 |
| CDS | − | 72911 | 74521 | yabK | b0067 |
| CDS | − | 74497 | 75480 | tbpA | b0068 |
| CDS | − | 75644 | 77299 | yabN | b0069 |
| CDS | + | 77621 | 78799 | setA | b0070 |
| CDS | − | 78848 | 79453 | leuD | b0071 |
| CDS | − | 79464 | 80864 | leuC | b0072 |
| CDS | − | 80867 | 81958 | leuB | b0073 |
| CDS | − | 81958 | 83529 | leuA | b0074 |
| CDS | − | 83622 | 83708 | leuL | b0075 |
| CDS | + | 84368 | 85312 | leuO | b0076 |
| CDS | + | 85630 | 87354 | ilvI | b0077 |
| CDS | + | 87357 | 87848 | ilvH | b0078 |
| CDS | + | 87860 | 87946 | fruL | b0079 |
| CDS | + | 88028 | 89032 | fruR | b0080 |
| CDS | + | 89634 | 90092 | yabB | b0081 |
| CDS | + | 90094 | 91035 | yabC | b0082 |
| CDS | + | 91032 | 91397 | ftsL | b0083 |
| CDS | + | 91413 | 93179 | ftsI | b0084 |
| CDS | + | 93166 | 94653 | murE | b0085 |
| CDS | + | 94650 | 96008 | murF | b0086 |
| CDS | + | 96002 | 97084 | mraY | b0087 |
| CDS | + | 97087 | 98403 | murD | b0088 |
| CDS | + | 98403 | 99647 | ftsW | b0089 |
| CDS | + | 99644 | 100711 | murG | b0090 |
| CDS | + | 100765 | 102240 | murC | b0091 |
| CDS | + | 102233 | 103153 | ddlB | b0092 |
| CDS | + | 103155 | 103985 | ftsQ | b0093 |
| CDS | + | 103982 | 105244 | ftsA | b0094 |
| CDS | + | 105305 | 106456 | ftsZ | b0095 |
| CDS | + | 106557 | 107474 | lpxC | b0096 |
| CDS | + | 107705 | 108217 | yacA | b0097 |
| CDS | + | 108279 | 110984 | secA | b0098 |
| CDS | + | 111044 | 111433 | mutT | b0099 |
| CDS | − | 111564 | 111698 |  | b0100 |
| CDS | − | 111649 | 111846 | yacG | b0101 |
| CDS | − | 111856 | 112599 | yacF | b0102 |
| CDS | − | 112599 | 113219 | yacE | b0103 |
| CDS | + | 113444 | 114487 | guaC | b0104 |
| CDS | − | 114407 | 114514 |  | b0105 |
| CDS | − | 114522 | 115724 | hofC | b0106 |
| CDS | − | 115714 | 117099 | hofB | b0107 |
| CDS | − | 117109 | 117549 | ppdD | b0108 |
| CDS | − | 117752 | 118645 | nadC | b0109 |
| CDS | + | 118733 | 119284 | ampD | b0110 |
| CDS | + | 119281 | 120135 | ampE | b0111 |
| CDS | − | 120178 | 121551 | aroP | b0112 |
| CDS | + | 122092 | 122856 | pdhR | b0113 |
| CDS | + | 123017 | 125680 | aceE | b0114 |
| CDS | + | 125695 | 127587 | aceF | b0115 |
| CDS | + | 127912 | 129336 | lpdA | b0116 |
| CDS | − | 129407 | 131260 | yacH | b0117 |
| CDS | + | 131615 | 134212 | acnB | b0118 |
| CDS | + | 134388 | 134750 | yacL | b0119 |
| CDS | − | 134788 | 135582 | speD | b0120 |
| CDS | − | 135598 | 136464 | speE | b0121 |
| CDS | − | 136570 | 136917 | yacC | b0122 |
| CDS | + | 137083 | 138633 | cueO | b0123 |
| CDS | − | 138835 | 141225 | gcd | b0124 |
| CDS | + | 141431 | 141967 | hpt | b0125 |
| CDS | − | 142008 | 142670 | yadF | b0126 |
| CDS | + | 142779 | 143705 | yadG | b0127 |
| CDS | + | 143702 | 144472 | yadH | b0128 |
| CDS | + | 144577 | 145017 | yadI | b0129 |
| CDS | + | 145081 | 146310 | yadE | b0130 |
| CDS | − | 146314 | 146694 | panD | b0131 |
| CDS | + | 146968 | 147870 | yadD | b0132 |
| CDS | − | 147944 | 148795 | panC | b0133 |
| CDS | − | 148807 | 149601 | panB | b0134 |
| CDS | − | 149715 | 150953 | yadC | b0135 |
| CDS | − | 151003 | 151599 | yadK | b0136 |
| CDS | − | 151626 | 152231 | yadL | b0137 |
| CDS | − | 152243 | 152812 | yadM | b0138 |
| CDS | − | 152829 | 155426 | htrE | b0139 |
| CDS | − | 155461 | 156201 | ecpD | b0140 |
| CDS | − | 156299 | 156883 | yadN | b0141 |
| CDS | − | 157253 | 157732 | folK | b0142 |
| CDS | − | 157729 | 159126 | pcnB | b0143 |
| CDS | − | 159186 | 160112 | yadB | b0144 |
| CDS | − | 160149 | 160604 | dksA | b0145 |
| CDS | − | 160782 | 161486 | sfsA | b0146 |
| CDS | − | 161501 | 162031 | ligT | b0147 |
| CDS | + | 162105 | 164534 | hrpB | b0148 |
| CDS | + | 164730 | 167264 | mrcB | b0149 |
| CDS | + | 167484 | 169727 | fhuA | b0150 |
| CDS | + | 169778 | 170575 | fhuC | b0151 |
| CDS | + | 170575 | 171465 | fhuD | b0152 |
| CDS | + | 171462 | 173444 | fhuB | b0153 |
| CDS | − | 173602 | 174882 | hemL | b0154 |
| CDS | + | 175107 | 176528 | yadQ | b0155 |
| CDS | + | 176610 | 176954 | yadR | b0156 |
| CDS | − | 177001 | 177624 | yadS | b0157 |
| CDS | − | 177662 | 178462 | yadT | b0158 |
| CDS | − | 178455 | 179153 | pfs | b0159 |
| CDS | + | 179237 | 180754 | dgt | b0160 |
| CDS | + | 180884 | 182308 | degP | b0161 |
| CDS | + | 182463 | 183620 | cdaR | b0162 |
| CDS | − | 183709 | 184095 | yaeH | b0163 |
| CDS | − | 184257 | 185069 | yaeI | b0164 |
| CDS | − | 184987 | 185118 |  | b0165 |
| CDS | − | 185123 | 185947 | dapD | b0166 |
| CDS | − | 185978 | 188650 | glnD | b0167 |
| CDS | − | 188712 | 189506 | map | b0168 |
| CDS | + | 189874 | 190599 | rpsB | b0169 |
| CDS | + | 190857 | 191708 | tsf | b0170 |
| CDS | + | 191855 | 192580 | pyrH | b0171 |
| CDS | + | 192872 | 193429 | frr | b0172 |
| CDS | + | 193521 | 194717 | ispC | b0173 |
| CDS | + | 194903 | 195664 | uppS | b0174 |
| CDS | + | 195677 | 196534 | cdsA | b0175 |
| CDS | + | 196546 | 197898 | yaeL | b0176 |
| CDS | + | 197928 | 200360 | yaeT | b0177 |
| CDS | + | 200482 | 200967 | hlpA | b0178 |
| CDS | + | 200971 | 201996 | lpxD | b0179 |
| CDS | + | 202101 | 202556 | fabZ | b0180 |
| CDS | + | 202560 | 203348 | lpxA | b0181 |
| CDS | + | 203348 | 204496 | lpxB | b0182 |
| CDS | + | 204493 | 205089 | rnhB | b0183 |
| CDS | + | 205126 | 208608 | dnaE | b0184 |
| CDS | + | 208621 | 209580 | accA | b0185 |
| CDS | + | 209679 | 211820 | ldcC | b0186 |
| CDS | + | 211877 | 212266 | yaeR | b0187 |
| CDS | + | 212331 | 213629 | tilS | b0188 |
| CDS | − | 213678 | 213932 | rof | b0189 |
| CDS | + | 214291 | 214836 | yaeQ | b0190 |
| CDS | + | 214833 | 215255 | yaeJ | b0191 |
| CDS | + | 215269 | 215979 | cutF | b0192 |
| CDS | − | 216179 | 217003 | yaeF | b0193 |
| CDS | + | 217057 | 218775 | proS | b0194 |
| CDS | − | 218887 | 219594 | yaeB | b0195 |
| CDS | − | 219591 | 219995 | rcsF | b0196 |
| CDS | − | 220113 | 220928 | metQ | b0197 |
| CDS | − | 220968 | 221621 | metI | b0198 |
| CDS | − | 221614 | 222645 | metN | b0199 |
| CDS | + | 222833 | 223408 | gmhB | b0200 |
| rRNA | + | 223771 | 225312 | rrsH | b0201 |
| tRNA | + | 225381 | 225457 | ileV | b0202 |
| tRNA | + | 225500 | 225575 | alaV | b0203 |
| rRNA | + | 225759 | 228662 | rrlH | b0204 |
| rRNA | + | 228756 | 228875 | rrfH | b0205 |
| tRNA | + | 228928 | 229004 | aspU | b0206 |
| CDS | + | 229167 | 229970 | dkgB | b0207 |
| CDS | − | 229961 | 230881 | yafC | b0208 |
| CDS | + | 231122 | 231922 | yafD | b0209 |
| CDS | + | 231926 | 232549 | yafE | b0210 |
| CDS | − | 232597 | 233955 | mltD | b0211 |
| CDS | − | 234027 | 234782 | gloB | b0212 |
| CDS | + | 234816 | 235538 | yafS | b0213 |
| CDS | − | 235535 | 236002 | rnhA | b0214 |
| CDS | + | 236067 | 236798 | dnaQ | b0215 |
| tRNA | − | 236931 | 237007 | aspV | b0216 |
| CDS | + | 237335 | 238120 | yafT | b0217 |
| CDS | − | 238746 | 239084 | yafU | b0218 |
| CDS | − | 239419 | 240189 | yafV | b0219 |
| CDS | + | 240343 | 240816 | ivy | b0220 |
| CDS | − | 240859 | 243303 | fadE | b0221 |

TABLE 1-continued

| Type | S | Left | Right | Name | B |
|---|---|---|---|---|---|
| CDS | + | 243543 | 244121 | lpcA | b0222 |
| CDS | + | 244327 | 245094 | yafJ | b0223 |
| CDS | − | 245065 | 245805 | yafK | b0224 |
| CDS | − | 245961 | 246239 | yafQ | b0225 |
| CDS | − | 246242 | 246502 | dinJ | b0226 |
| CDS | + | 246712 | 247461 | yafL | b0227 |
| CDS | + | 247637 | 248134 | yafM | b0228 |
| CDS | − | 248358 | 250070 | fhiA | b0229 |
| CDS | + | 250072 | 250827 | mbhA | b0230 |
| CDS | + | 250898 | 251953 | dinB | b0231 |
| CDS | + | 252005 | 252298 | yafN | b0232 |
| CDS | + | 252301 | 252699 | yafO | b0233 |
| CDS | + | 252709 | 253161 | yafP | b0234 |
| CDS | + | 253467 | 253733 | ykfJ | b0235 |
| CDS | + | 253702 | 254202 | prfH | b0236 |
| CDS | − | 254259 | 255716 | pepD | b0237 |
| CDS | + | 255977 | 256435 | gpt | b0238 |
| CDS | + | 256527 | 257771 | yafA | b0239 |
| CDS | + | 257829 | 256230 | crl | b0240 |
| CDS | − | 258269 | 259324 | phoE | b0241 |
| CDS | + | 259612 | 260715 | proB | b0242 |
| CDS | + | 260727 | 261980 | proA | b0243 |
| tRNA | + | 262095 | 262170 | thrW | b0244 |
| CDS | − | 262552 | 262893 | ykfI | b0245 |
| CDS | − | 262914 | 263231 | yafW | b0246 |
| CDS | − | 263480 | 263956 | ykfG | b0247 |
| CDS | − | 263972 | 264430 | yafX | b0248 |
| CDS | − | 264528 | 264767 | ykfF | b0249 |
| CDS | − | 264844 | 265311 | ykfB | b0250 |
| CDS | − | 265334 | 266191 | yafY | b0251 |
| CDS | − | 266408 | 267229 | yafZ | b0252 |
| CDS | − | 267321 | 268184 | ykfA | b0253 |
| CDS | − | 268513 | 269406 | perR | b0254 |
| repeat_region | + | 269430 | 269994 | | |
| CDS | + | 269466 | 269870 | yi91a | b0255 |
| repeat_region | + | 269765 | 270985 | | |
| CDS | + | 269827 | 270978 | tra8_1 | b0256 |
| repeat_region | + | 270930 | 271751 | | |
| CDS | + | 271054 | 271479 | | b0257 |
| CDS | + | 272071 | 273216 | ykfC | b0258 |
| repeat_region | + | 273179 | 274373 | | |
| CDS | − | 273325 | 274341 | trs5_1 | b0259 |
| CDS | + | 274549 | 275952 | mmuP | b0260 |
| CDS | + | 275939 | 276871 | mmuM | b0261 |
| CDS | − | 276980 | 278026 | afuC | b0262 |
| CDS | − | 278038 | 278400 | afuB | b0263 |
| repeat_region | − | 278387 | 279154 | | |
| CDS | − | 278402 | 278905 | insB_2 | b0264 |
| CDS | − | 278824 | 279099 | insA_2 | b0265 |
| repeat_region | + | 279155 | 279335 | | |
| CDS | − | 279609 | 279959 | yagB | b0266 |
| CDS | − | 280053 | 281207 | yagA | b0267 |
| CDS | + | 281481 | 282410 | yagE | b0268 |
| CDS | + | 282425 | 284392 | yagF | b0269 |
| CDS | + | 284619 | 286001 | yagG | b0270 |
| CDS | + | 286013 | 287623 | yagH | b0271 |
| CDS | + | 287628 | 288386 | yagI | b0272 |
| CDS | + | 288525 | 289529 | argF | b0273 |
| repeat_region | − | 289858 | 290625 | | |
| CDS | − | 289873 | 290376 | insB_3 | b0274 |
| CDS | − | 290295 | 290570 | insA_3 | b0275 |
| CDS | + | 290724 | 291455 | yagJ | b0276 |
| CDS | − | 291546 | 292172 | yagK | b0277 |
| CDS | − | 292444 | 293142 | yagL | b0278 |
| CDS | − | 293169 | 294023 | yagM | b0279 |
| CDS | − | 294363 | 294803 | yagN | b0280 |
| CDS | − | 294920 | 296320 | intF | b0281 |
| CDS | − | 296605 | 297015 | yagP | b0282 |
| CDS | − | 296994 | 297950 | yagQ | b0283 |
| CDS | − | 297960 | 300158 | yagR | b0284 |
| CDS | − | 300155 | 301111 | yagS | b0285 |
| CDS | − | 301108 | 301797 | yagT | b0286 |
| CDS | + | 302215 | 302829 | yagU | b0287 |
| CDS | − | 303077 | 303406 | ykgJ | b0288 |
| CDS | − | 303719 | 304429 | aygV | b0289 |
| CDS | − | 304398 | 306041 | yagW | b0290 |
| CDS | − | 306031 | 308556 | yagX | b0291 |
| CDS | − | 308582 | 309250 | yagY | b0292 |
| CDS | − | 309308 | 309895 | yagZ | b0293 |
| CDS | − | 309970 | 310560 | ykgK | b0294 |
| CDS | + | 311336 | 311563 | ykgL | b0295 |
| CDS | − | 311738 | 312001 | ykgM | b0296 |
| CDS | + | 313581 | 314468 | eaeH | b0297 |
| repeat_region | + | 314453 | 315707 | | |
| CDS | + | 314506 | 314814 | | b0298 |
| CDS | + | 314811 | 315677 | tra5_5 | b0299 |
| CDS | − | 315674 | 316360 | ykgA | b0300 |
| CDS | + | 316950 | 317543 | ykgB | b0301 |
| CDS | − | 317555 | 317791 | ykgI | b0303 |
| CDS | − | 317900 | 319225 | ykgC | b0304 |
| CDS | + | 319451 | 320305 | ykgD | b0305 |
| CDS | + | 320832 | 321551 | ykgE | b0306 |
| CDS | + | 321562 | 322989 | ykgF | b0307 |
| CDS | + | 322982 | 323677 | ykgG | b0308 |
| CDS | − | 323632 | 323844 | | b0309 |
| CDS | − | 323920 | 324588 | ykgH | b0310 |
| CDS | − | 324801 | 326471 | betA | b0311 |
| CDS | − | 326485 | 327957 | betB | b0312 |
| CDS | − | 327971 | 328558 | betI | b0313 |
| CDS | + | 328687 | 330720 | betT | b0314 |
| CDS | + | 331595 | 332683 | yahA | b0315 |
| CDS | + | 332725 | 333657 | yahB | b0316 |
| CDS | − | 333749 | 334246 | yahC | b0317 |
| CDS | + | 334504 | 335109 | yahD | b0318 |
| CDS | + | 335149 | 336012 | yahE | b0319 |
| CDS | + | 336002 | 337549 | yahF | b0320 |
| CDS | + | 337549 | 338967 | yahG | b0321 |
| CDS | + | 339389 | 340339 | yahI | b0323 |
| CDS | + | 340349 | 341731 | yahJ | b0324 |
| CDS | + | 342108 | 343157 | yahK | b0325 |
| CDS | + | 343400 | 344215 | yahL | b0326 |
| CDS | + | 344628 | 344873 | YahM | b0327 |
| CDS | − | 344890 | 345561 | yahN | b0328 |
| CDS | + | 345708 | 345983 | yahO | b0329 |
| CDS | − | 346081 | 347667 | prpR | b0330 |
| CDS | + | 347906 | 348796 | prpB | b0331 |
| CDS | + | 349236 | 350405 | prpC | b0333 |
| CDS | + | 350439 | 351890 | prpD | b0334 |
| CDS | + | 351930 | 353816 | prpE | b0335 |
| CDS | + | 354146 | 355405 | codB | b0336 |
| CDS | + | 355395 | 356678 | codA | b0337 |
| CDS | − | 357015 | 357914 | cynR | b0338 |
| CDS | + | 358023 | 358682 | cynT | b0339 |
| CDS | + | 358713 | 359183 | cynS | b0340 |
| CDS | + | 359216 | 360370 | cynX | b0341 |
| CDS | − | 360473 | 361084 | lacA | b0342 |
| CDS | − | 361150 | 362403 | lacY | b0343 |
| CDS | − | 362455 | 365529 | lacZ | b0344 |
| CDS | − | 365652 | 366734 | lacI | b0345 |
| CDS | − | 366811 | 367758 | mhpR | b0346 |
| CDS | + | 367835 | 369499 | mhpA | b0347 |
| CDS | + | 369501 | 370445 | mhpB | b0348 |
| CDS | + | 370448 | 371329 | mhpC | b0349 |
| CDS | + | 371339 | 372148 | mhpD | b0350 |
| CDS | + | 372145 | 373095 | mhpF | b0351 |
| CDS | + | 373092 | 374105 | mhpE | b0352 |
| CDS | + | 374683 | 375894 | mhpT | b0353 |
| CDS | + | 375996 | 376535 | yaiL | b0354 |
| CDS | − | 376759 | 377592 | frmB | b0355 |
| CDS | − | 377686 | 378795 | frmA | b0356 |
| CDS | − | 378830 | 379105 | frmR | b0357 |
| CDS | − | 379293 | 380066 | yaiO | b0358 |
| CDS | − | 380068 | 380283 | | b0359 |
| repeat_region | − | 380484 | 381814 | | |
| CDS | + | 380530 | 380940 | yi21_1 | b0360 |
| CDS | + | 380898 | 381803 | yi22_1 | b0361 |
| CDS | − | 381728 | 382114 | | b0362 |
| CDS | + | 381963 | 383159 | yaiP | b0363 |
| CDS | − | 383283 | 383840 | yaiS | b0364 |
| CDS | + | 384456 | 385418 | tauA | b0365 |
| CDS | + | 385431 | 386198 | tauB | b0366 |
| CDS | + | 386195 | 387022 | tauC | b0367 |
| CDS | + | 387019 | 387870 | tauD | b0368 |
| CDS | − | 387977 | 388951 | hemB | b0369 |
| CDS | − | 389121 | 389339 | | b0370 |
| CDS | + | 389475 | 390935 | yaiT | b0371 |

TABLE 1-continued

| Type | S | Left | Right | Name | B |
|---|---|---|---|---|---|
| repeat_region | − | 390933 | 392190 | | |
| CDS | − | 390963 | 391829 | tra5_1 | b0372 |
| CDS | − | 391826 | 392134 | | b0373 |
| CDS | + | 392239 | 393642 | yaiU | b0374 |
| CDS | + | 393685 | 394353 | yaiV | b0375 |
| CDS | − | 394354 | 395511 | ampH | b0376 |
| CDS | + | 395863 | 397083 | sbmA | b0377 |
| CDS | + | 397096 | 398190 | yaiW | b0378 |
| CDS | − | 398249 | 398557 | yaiY | b0379 |
| CDS | + | 398817 | 399029 | yaiZ | b0380 |
| CDS | − | 399053 | 400147 | ddlA | b0381 |
| CDS | + | 400610 | 400870 | yaiB | b0382 |
| CDS | + | 400971 | 402386 | phoA | b0383 |
| CDS | + | 402505 | 402825 | psiF | b0384 |
| CDS | + | 402927 | 404042 | yaiC | b0385 |
| CDS | − | 404059 | 404868 | proC | b0386 |
| CDS | + | 404988 | 405446 | yaiI | b0387 |
| CDS | + | 405629 | 406153 | aroL | b0388 |
| CDS | + | 406203 | 406394 | yaiA | b0389 |
| CDS | + | 406652 | 407329 | aroM | b0390 |
| CDS | + | 407401 | 407685 | yaiE | b0391 |
| CDS | + | 407893 | 408174 | ykiA | b0392 |
| CDS | − | 408332 | 409243 | yaiD | b0393 |
| CDS | + | 409368 | 410276 | yajF | b0394 |
| CDS | − | 410521 | 411705 | araJ | b0396 |
| CDS | − | 411831 | 414977 | sbcC | b0397 |
| CDS | − | 414974 | 416176 | sbcD | b0398 |
| CDS | + | 416366 | 417055 | phoB | b0399 |
| CDS | + | 417113 | 418408 | phoR | b0400 |
| CDS | + | 418815 | 420134 | brnQ | b0401 |
| CDS | + | 420210 | 421583 | proY | b0402 |
| CDS | + | 421739 | 423556 | malZ | b0403 |
| CDS | − | 423561 | 424142 | yajB | b0404 |
| CDS | + | 424235 | 425305 | queA | b0405 |
| CDS | + | 425361 | 426488 | tgt | b0406 |
| CDS | + | 426511 | 426843 | yajC | b0407 |
| CDS | + | 426871 | 428718 | secD | b0408 |
| CDS | + | 428729 | 429700 | secF | b0409 |
| CDS | + | 429829 | 430176 | yajD | b0410 |
| CDS | − | 430353 | 431237 | tsx | b0411 |
| CDS | − | 431536 | 432075 | yajI | b0412 |
| CDS | + | 432226 | 432675 | ybaD | b0413 |
| CDS | + | 432679 | 433782 | ribD | b0414 |
| CDS | + | 433871 | 434341 | ribE | b0415 |
| CDS | + | 434361 | 434780 | nusB | b0416 |
| CDS | + | 434858 | 435835 | thiL | b0417 |
| CDS | + | 435813 | 436331 | pgpA | b0418 |
| CDS | − | 436385 | 437359 | yajO | b0419 |
| CDS | − | 437539 | 439401 | dxs | b0420 |
| CDS | − | 439426 | 440325 | ispA | b0421 |
| CDS | − | 440325 | 440567 | xseB | b0422 |
| CDS | + | 440773 | 442221 | thiI | b0423 |
| CDS | − | 442275 | 442865 | thiJ | b0424 |
| CDS | − | 442828 | 443739 | apbA | b0425 |
| CDS | + | 443907 | 444398 | yajQ | b0426 |
| CDS | − | 444526 | 445890 | yajR | b0427 |
| CDS | − | 446039 | 446929 | cyoE | b0428 |
| CDS | − | 446941 | 447270 | cyoD | b0429 |
| CDS | − | 447270 | 447884 | cyoC | b0430 |
| CDS | − | 447874 | 449865 | cyoB | b0431 |
| CDS | − | 449887 | 450834 | cyoA | b0432 |
| CDS | − | 451294 | 452769 | ampG | b0433 |
| CDS | − | 452813 | 453391 | yajG | b0434 |
| CDS | + | 453696 | 454013 | bolA | b0435 |
| CDS | + | 454357 | 455655 | tig | b0436 |
| CDS | + | 455901 | 456524 | clpP | b0437 |
| CDS | + | 456650 | 457924 | clpX | b0438 |
| CDS | + | 458112 | 460466 | lon | b0439 |
| CDS | + | 460675 | 460947 | hupB | b0440 |
| CDS | + | 461139 | 463010 | ppiD | b0441 |
| CDS | + | 463161 | 463532 | ybaV | b0442 |
| CDS | + | 463626 | 464024 | ybaW | b0443 |
| CDS | − | 464076 | 464771 | ybaX | b0444 |
| CDS | − | 464836 | 466536 | ybaE | b0445 |
| CDS | + | 466636 | 467454 | cof | b0446 |
| CDS | + | 467607 | 468065 | ybaO | b0447 |
| CDS | + | 468095 | 469867 | mdlA | b0448 |
| CDS | + | 469860 | 471641 | mdlB | b0449 |
| CDS | + | 471822 | 472160 | glnK | b0450 |
| CDS | + | 472190 | 473476 | amtB | b0451 |
| CDS | − | 473525 | 474385 | tesB | b0452 |
| CDS | + | 474603 | 475175 | ybaY | b0453 |
| CDS | − | 475206 | 475595 | ybaZ | b0454 |
| misc_RNA | + | 475672 | 475785 | ffs | b0455 |
| CDS | + | 475896 | 476249 | ybaA | b0456 |
| CDS | − | 476291 | 477841 | ylaB | b0457 |
| CDS | − | 478005 | 478475 | ylaC | b0458 |
| CDS | − | 478591 | 479142 | maa | b0459 |
| CDS | − | 479314 | 479532 | hha | b0460 |
| CDS | − | 479558 | 479932 | ybaJ | b0461 |
| CDS | − | 480478 | 483627 | acrB | b0462 |
| CDS | − | 483650 | 484843 | acrA | b0463 |
| CDS | + | 484985 | 485632 | acrR | b0464 |
| CDS | + | 485760 | 489122 | kefA | b0465 |
| CDS | − | 489334 | 489495 | ybaM | b0466 |
| CDS | − | 489509 | 490036 | priC | b0467 |
| CDS | + | 490106 | 490483 | ybaN | b0468 |
| CDS | + | 490636 | 491187 | apt | b0469 |
| CDS | + | 491316 | 493247 | dnaX | b0470 |
| CDS | + | 493300 | 493629 | ybaB | b0471 |
| CDS | + | 493629 | 494234 | recR | b0472 |
| CDS | + | 494344 | 496218 | htpG | b0473 |
| CDS | + | 496399 | 497043 | adk | b0474 |
| CDS | + | 497279 | 498241 | hemH | b0475 |
| CDS | − | 498238 | 499197 | aes | b0476 |
| CDS | + | 499349 | 500653 | gsk | b0477 |
| CDS | − | 500786 | 502462 | ybaL | b0478 |
| CDS | − | 502700 | 503920 | fsr | b0479 |
| CDS | + | 504138 | 505790 | ushA | b0480 |
| CDS | + | 505827 | 506306 | ybaK | b0481 |
| CDS | − | 506510 | 507304 | ybaP | b0482 |
| CDS | + | 507442 | 507783 | ybaQ | b0483 |
| CDS | − | 508099 | 510603 | copA | b0484 |
| CDS | + | 510865 | 511797 | ybaS | b0485 |
| CDS | + | 511800 | 513092 | ybaT | b0486 |
| CDS | + | 513217 | 513624 | cueR | b0487 |
| CDS | − | 513625 | 514080 | ybbJ | b0488 |
| CDS | − | 514080 | 514997 | ybbK | b0489 |
| CDS | + | 515143 | 515820 | ybbL | b0490 |
| CDS | + | 515807 | 516586 | ybbM | b0491 |
| CDS | − | 516649 | 517503 | ybbN | b0492 |
| CDS | − | 517564 | 518373 | ybbO | b0493 |
| CDS | − | 518363 | 518989 | tesA | b0494 |
| CDS | + | 518957 | 519643 | ybbA | b0495 |
| CDS | + | 519640 | 522054 | ybbP | b0496 |
| CDS | + | 522485 | 526765 | rhsD | b0497 |
| CDS | + | 526805 | 527173 | ybbC | b0498 |
| CDS | + | 527173 | 527883 | ylbH | b0499 |
| CDS | + | 527864 | 528124 | ybbD | b0500 |
| CDS | + | 528163 | 528354 | | b0501 |
| CDS | − | 528869 | 529240 | ylbG | b0502 |
| CDS | − | 529356 | 530450 | ybbB | b0503 |
| CDS | − | 530519 | 531445 | ybbS | b0504 |
| CDS | + | 531675 | 532157 | allA | b0505 |
| CDS | + | 532235 | 533050 | allR | b0506 |
| CDS | + | 533140 | 534921 | gcl | b0507 |
| CDS | + | 534934 | 535710 | hyi | b0508 |
| CDS | + | 535810 | 536688 | glxR | b0509 |
| CDS | + | 536720 | 536998 | ybbV | b0510 |
| CDS | + | 536857 | 538311 | allP | b0511 |
| CDS | + | 538371 | 539732 | allB | b0512 |
| CDS | + | 539789 | 541090 | ybbY | b0513 |
| CDS | + | 541112 | 542257 | glxK | b0514 |
| CDS | − | 542485 | 543270 | ylbA | b0515 |
| CDS | − | 543281 | 544516 | allC | b0516 |
| CDS | − | 544538 | 545587 | allD | b0517 |
| CDS | + | 545904 | 547571 | fdrA | b0518 |
| CDS | + | 547838 | 548839 | ylbE | b0519 |
| CDS | + | 548850 | 549665 | ylbF | b0520 |
| CDS | + | 549662 | 550555 | arcC | b0521 |
| CDS | − | 550750 | 551817 | purK | b0522 |
| CDS | − | 551814 | 552323 | purE | b0523 |
| CDS | − | 552441 | 553163 | ybbF | b0524 |
| CDS | + | 553166 | 553660 | ppiB | b0525 |
| CDS | + | 553834 | 555219 | cysS | b0526 |
| CDS | − | 555255 | 555776 | ybcI | b0527 |

TABLE 1-continued

| Type | S | Left | Right | Name | B |
|---|---|---|---|---|---|
| CDS | − | 555884 | 556096 | ybcJ | b0528 |
| CDS | − | 556098 | 556964 | folD | b0529 |
| CDS | + | 557435 | 557977 | sfmA | b0530 |
| CDS | + | 558197 | 558889 | sfmC | b0531 |
| CDS | + | 558920 | 561523 | sfmD | b0532 |
| CDS | + | 561565 | 562542 | sfmH | b0533 |
| CDS | + | 562553 | 563068 | sfmF | b0534 |
| CDS | − | 563071 | 563703 | fimZ | b0535 |
| tRNA | + | 563946 | 564022 | argU | b0536 |
| CDS | − | 564038 | 565201 | intD | b0537 |
| CDS | + | 565195 | 565755 |  | b0538 |
| CDS | − | 565321 | 565584 | ybcC | b0539 |
| repeat_region | + | 566000 | 567257 |  |  |
| CDS | + | 566056 | 566364 |  | b0540 |
| CDS | + | 566361 | 567227 | tra5_2 | b0541 |
| CDS | + | 567285 | 567470 |  | b0542 |
| CDS | + | 567538 | 567870 | emrE | b0543 |
| CDS | + | 568125 | 569651 | ybcK | b0544 |
| CDS | + | 570116 | 570667 | ybcL | b0545 |
| CDS | + | 570677 | 571474 | ybcM | b0546 |
| CDS | + | 571689 | 572144 | ybcN | b0547 |
| CDS | + | 572144 | 572314 | ninE | b0548 |
| CDS | + | 572307 | 572597 | ybcO | b0549 |
| CDS | + | 572594 | 572956 | rus | b0550 |
| CDS | + | 573179 | 573562 | ybcQ | b0551 |
| repeat_region | + | 573814 | 575008 |  |  |
| CDS | − | 573960 | 574976 | trs5_2 | b0552 |
| CDS | − | 574981 | 576108 | nmpC | b0553 |
| CDS | + | 576621 | 576836 | ybcR | b0554 |
| CDS | + | 576836 | 577333 | ybcS | b0555 |
| CDS | + | 577330 | 577791 | ybcT | b0556 |
| CDS | − | 577823 | 578116 | ybcU | b0557 |
| CDS | − | 578407 | 578817 | ybcV | b0558 |
| CDS | + | 579103 | 579309 | ybcW | b0559 |
| CDS | + | 580057 | 580602 | nohB | b0560 |
| CDS | + | 580757 | 581320 | ybcX | b0561 |
| CDS | − | 581375 | 581959 | ybcY | b0562 |
| CDS | + | 582098 | 582283 | ylcE | b0563 |
| CDS | + | 582904 | 583653 | appY | b0564 |
| CDS | − | 583903 | 584856 | ompT | b0565 |
| CDS | − | 585370 | 586131 | envY | b0566 |
| CDS | − | 586314 | 587204 | ybcH | b0567 |
| CDS | − | 587205 | 590177 | nfrA | b0568 |
| CDS | − | 590164 | 592401 | nfrB | b0569 |
| CDS | − | 592551 | 593993 | cusS | b0570 |
| CDS | − | 593983 | 594666 | cusR | b0571 |
| CDS | + | 594823 | 596196 | cusC | b0572 |
| CDS | + | 596354 | 596686 | ylcC | b0573 |
| CDS | + | 596702 | 597925 | cusB | b0574 |
| CDS | + | 597937 | 601080 | cusA | b0575 |
| CDS | + | 601182 | 602556 | pheP | b0576 |
| CDS | − | 602639 | 603886 | ybdG | b0577 |
| CDS | − | 603994 | 604647 | nfnB | b0578 |
| CDS | − | 604741 | 605109 | ybdF | b0579 |
| CDS | − | 605174 | 605422 | ybdJ | b0580 |
| CDS | − | 605488 | 606606 | ybdK | b0581 |
| repeat_region | + | 607231 | 608573 |  |  |
| CDS | + | 607288 | 608400 | yi81_2 | b0582 |
| CDS | − | 608682 | 609311 | entD | b0583 |
| CDS | − | 609477 | 611717 | fepA | b0584 |
| CDS | + | 612038 | 613162 | fes | b0585 |
| CDS | + | 613380 | 617261 | entF | b0586 |
| CDS | + | 617477 | 618610 | fepE | b0587 |
| CDS | − | 618607 | 619422 | fepC | b0588 |
| CDS | − | 619419 | 620411 | fepG | b0589 |
| CDS | − | 620408 | 621412 | fepD | b0590 |
| CDS | + | 621523 | 622773 | ybdA | b0591 |
| CDS | − | 622777 | 623733 | fepB | b0592 |
| CDS | + | 624108 | 625283 | entC | b0593 |
| CDS | + | 625293 | 626903 | entE | b0594 |
| CDS | + | 626917 | 627774 | entB | b0595 |
| CDS | + | 627774 | 628520 | entA | b0596 |
| CDS | + | 628523 | 628963 | ybdB | b0597 |
| CDS | + | 629117 | 631222 | cstA | b0598 |
| CDS | − | 631612 | 632700 | ybdH | b0599 |
| CDS | + | 632809 | 633969 | ybdL | b0600 |
| CDS | − | 633970 | 634599 | ybdM | b0601 |
| CDS | − | 634572 | 635792 | ybdN | b0602 |
| CDS | − | 635939 | 636841 | ybdO | b0603 |
| CDS | − | 637050 | 637796 | dsbG | b0604 |
| CDS | + | 638168 | 638731 | ahpC | b0605 |
| CDS | + | 638976 | 640541 | ahpF | b0606 |
| CDS | − | 640662 | 641090 | ybdQ | b0607 |
| CDS | + | 641311 | 642549 | ybdR | b0608 |
| CDS | + | 642630 | 643091 |  | b0609 |
| CDS | − | 642780 | 643190 | rnk | b0610 |
| CDS | − | 643420 | 644226 | rna | b0611 |
| CDS | − | 644340 | 645803 | citT | b0612 |
| CDS | − | 645854 | 646732 | citG | b0613 |
| CDS | − | 646707 | 647258 | ybdU | b0614 |
| CDS | − | 647262 | 648794 | citF | b0615 |
| CDS | − | 648805 | 649713 | citE | b0616 |
| CDS | − | 649710 | 650006 | citD | b0617 |
| CDS | − | 650021 | 651079 | citC | b0618 |
| CDS | + | 651458 | 653116 | citA | b0619 |
| CDS | + | 653085 | 653765 | citB | b0620 |
| CDS | − | 653806 | 665191 | dcuC | b0621 |
| CDS | + | 655780 | 656340 | crcA | b0622 |
| CDS | + | 656515 | 656724 | cspE | b0623 |
| CDS | − | 656778 | 657161 | crcB | b0624 |
| CDS | + | 657254 | 657481 | ybeH | b0625 |
| CDS | + | 657478 | 658041 | ybeM | b0626 |
| CDS | + | 658170 | 658373 | tatE | b0627 |
| CDS | − | 658474 | 659439 | lipA | b0628 |
| CDS | − | 659648 | 660601 | ybeF | b0629 |
| CDS | − | 660860 | 661501 | lipB | b0630 |
| CDS | − | 661602 | 661865 | ybeD | b0631 |
| CDS | − | 661975 | 663186 | dacA | b0632 |
| CDS | − | 663325 | 664413 | rlpA | b0633 |
| CDS | − | 664424 | 665536 | mrdB | b0634 |
| CDS | − | 665539 | 667440 | mrdA | b0635 |
| CDS | − | 667471 | 667938 | ybeA | b0636 |
| CDS | − | 667942 | 668259 | ybeB | b0637 |
| CDS | − | 668519 | 669130 | phpB | b0638 |
| CDS | − | 669154 | 669795 | nadD | b0639 |
| CDS | − | 669797 | 670828 | holA | b0640 |
| CDS | − | 670828 | 671409 | rlpB | b0641 |
| CDS | − | 671424 | 674006 | leuS | b0642 |
| CDS | + | 674241 | 674723 | ybeL | b0643 |
| CDS | − | 674793 | 675770 | ybeQ | b0644 |
| CDS | + | 675934 | 676641 | ybeR | b0645 |
| CDS | + | 676638 | 678065 | ybeS | b0646 |
| CDS | − | 678075 | 678629 | ybeT | b0647 |
| CDS | + | 678731 | 679438 | ybeU | b0648 |
| CDS | + | 679435 | 680886 | ybeV | b0649 |
| CDS | − | 680946 | 682616 | hscC | b0650 |
| CDS | − | 682700 | 683635 | rihA | b0651 |
| CDS | − | 683753 | 684478 | gltL | b0652 |
| CDS | − | 684478 | 685152 | gltK | b0653 |
| CDS | − | 685152 | 685892 | gltJ | b0654 |
| CDS | − | 686062 | 686970 | gltI | b0655 |
| repeat_region | + | 687074 | 688268 |  |  |
| CDS | − | 687220 | 688236 | trs5_3 | b0656 |
| CDS | − | 688566 | 690104 | lnt | b0657 |
| CDS | − | 690129 | 691007 | ybeX | b0658 |
| CDS | + | 691097 | 691564 | ybeY | b0659 |
| CDS | − | 691561 | 692640 | ybeZ | b0660 |
| CDS | − | 692754 | 694178 | yleA | b0661 |
| CDS | + | 694324 | 695499 | ubiF | b0662 |
| tRNA | − | 695653 | 695727 | glnX | b0664 |
| tRNA | − | 695765 | 695839 | glnV | b0665 |
| tRNA | − | 695887 | 695963 | metU | b0666 |
| tRNA | − | 695979 | 696053 | glnW | b0668 |
| tRNA | − | 696088 | 696162 | glnU | b0670 |
| tRNA | − | 696186 | 696270 | leuW | b0672 |
| tRNA | − | 696280 | 696356 | metT | b0673 |
| CDS | − | 696736 | 698400 | asnB | b0674 |
| CDS | − | 698797 | 699549 | nagD | b0675 |
| CDS | − | 699597 | 700817 | nagC | b0676 |
| CDS | − | 700826 | 701974 | nagA | b0677 |
| CDS | − | 702034 | 702834 | nagB | b0678 |
| CDS | + | 703167 | 705113 | nagE | b0679 |
| CDS | + | 705316 | 706980 | glnS | b0680 |
| CDS | + | 707557 | 708963 | ybfM | b0681 |
| CDS | + | 709013 | 709339 | ybfN | b0682 |
| CDS | − | 709423 | 709869 | fur | b0683 |

TABLE 1-continued

| Type | S | Left | Right | Name | B |
|---|---|---|---|---|---|
| CDS | − | 710158 | 710688 | fldA | b0684 |
| CDS | − | 710828 | 711121 | ybfE | b0685 |
| CDS | − | 711261 | 712025 | ybfF | b0686 |
| CDS | + | 712210 | 712755 | seqA | b0687 |
| CDS | + | 712781 | 714421 | pgm | b0688 |
| CDS | + | 714635 | 715129 | ybfP | b0689 |
| CDS | − | 715170 | 715580 | ybfG | b0690 |
| CDS | − | 715611 | 715820 | ybfH | b0691 |
| CDS | − | 716169 | 717488 | potE | b0692 |
| CDS | − | 717485 | 719683 | speF | b0693 |
| CDS | − | 720279 | 720956 | kdpE | b0694 |
| CDS | − | 720953 | 723637 | kdpD | b0695 |
| CDS | − | 723630 | 724202 | kdpC | b0696 |
| CDS | − | 724211 | 726259 | kdpB | b0697 |
| CDS | − | 726282 | 727955 | KdpA | b0698 |
| CDS | + | 728357 | 728563 | ybfA | b0699 |
| CDS | + | 728806 | 732999 | rhsC | b0700 |
| CDS | + | 732593 | 732814 |  | b0701 |
| CDS | + | 732999 | 733325 | ybfB | b0702 |
| CDS | + | 733443 | 734876 | ybfO | b0703 |
| CDS | + | 734873 | 735442 | ybfC | b0704 |
| CDS | + | 736123 | 737184 | ybfL | b0705 |
| CDS | + | 737315 | 738076 | ybfD | b0706 |
| CDS | + | 738224 | 738733 | ybgA | b0707 |
| CDS | + | 738730 | 740148 | phrB | b0708 |
| CDS | − | 740298 | 741779 | ybgH | b0709 |
| CDS | + | 742050 | 742793 | ybgI | b0710 |
| CDS | + | 742816 | 743472 | ybgJ | b0711 |
| CDS | + | 743466 | 744398 | ybgK | b0712 |
| CDS | + | 744388 | 745122 | ybgL | b0713 |
| CDS | + | 745158 | 745949 | nei | b0714 |
| CDS | − | 745946 | 746992 | abrB | b0715 |
| CDS | − | 747144 | 748205 | ybgO | b0716 |
| CDS | − | 748202 | 748930 | ybgP | b0717 |
| CDS | − | 748945 | 751392 | ybgQ | b0718 |
| CDS | − | 751452 | 752018 | ybgD | b0719 |
| CDS | − | 752408 | 753691 | gltA | b0720 |
| CDS | + | 754400 | 754789 | sdhC | b0721 |
| CDS | + | 754783 | 755130 | sdhD | b0722 |
| CDS | + | 755130 | 756896 | sdhA | b0723 |
| CDS | + | 756912 | 757628 | sdhB | b0724 |
| CDS | + | 757687 | 757947 |  | b0725 |
| CDS | + | 757929 | 760730 | sucA | b0726 |
| CDS | + | 760745 | 761962 | sucB | b0727 |
| CDS | + | 762237 | 763403 | sucC | b0728 |
| CDS | + | 763403 | 764272 | sucD | b0729 |
| CDS | − | 764376 | 765098 | farR | b0730 |
| CDS | + | 765207 | 767183 | hrsA | b0731 |
| CDS | + | 767201 | 769834 | ybgG | b0732 |
| CDS | + | 770681 | 772249 | cydA | b0733 |
| CDS | + | 772265 | 773404 | cydB | b0734 |
| CDS | + | 773532 | 773825 | ybgE | b0735 |
| CDS | + | 773975 | 774379 | ybgC | b0736 |
| CDS | + | 774376 | 775068 | tolQ | b0737 |
| CDS | + | 775072 | 775500 | tolR | b0738 |
| CDS | + | 775565 | 776830 | tolA | b0739 |
| CDS | + | 776963 | 778255 | tolB | b0740 |
| CDS | + | 778290 | 778811 | pal | b0741 |
| CDS | + | 778821 | 779612 | ybgF | b0742 |
| tRNA | + | 779777 | 779852 | lysT | b0743 |
| tRNA | + | 779988 | 780063 | valT | b0744 |
| tRNA | + | 780066 | 780141 | lysW | b0745 |
| tRNA | + | 780291 | 780366 | valZ | b0746 |
| tRNA | + | 780370 | 780445 | lysY | b0747 |
| tRNA | + | 780592 | 780667 | lysZ | b0748 |
| tRNA | + | 780800 | 780875 | lysQ | b0749 |
| CDS | + | 781308 | 782351 | nadA | b0750 |
| CDS | + | 782389 | 783108 | pnuC | b0751 |
| CDS | − | 783105 | 784046 | ybgR | b0752 |
| CDS | − | 784160 | 784540 | ybgS | b0753 |
| CDS | + | 784856 | 785908 | aroG | b0754 |
| CDS | − | 786066 | 786818 | gpmA | b0755 |
| CDS | − | 787020 | 788060 | galM | b0756 |
| CDS | − | 788054 | 789202 | galK | b0757 |
| CDS | − | 789206 | 790252 | galT | b0758 |
| CDS | − | 790262 | 791278 | galE | b0759 |
| CDS | − | 791539 | 793011 | modF | b0760 |
| CDS | − | 793079 | 793867 | modE | b0761 |
| CDS | + | 793996 | 794145 | ybhT | b0762 |
| CDS | + | 794312 | 795085 | modA | b0763 |
| CDS | + | 795085 | 795774 | modB | b0764 |
| CDS | + | 795777 | 796835 | modC | b0765 |
| CDS | − | 796836 | 797654 | ybhA | b0766 |
| CDS | + | 797809 | 798804 | ybhE | b0767 |
| CDS | − | 798845 | 799861 | ybhD | b0768 |
| CDS | + | 799982 | 801034 | ybhH | b0769 |
| CDS | + | 801110 | 802543 | ybhI | b0770 |
| CDS | + | 802726 | 804987 | ybhJ | b0771 |
| CDS | − | 805221 | 806504 | ybhC | b0772 |
| CDS | − | 806656 | 807132 | ybhB | b0773 |
| CDS | − | 807191 | 808480 | bioA | b0774 |
| CDS | + | 808567 | 809607 | bioB | b0775 |
| CDS | + | 809604 | 810758 | bioF | b0776 |
| CDS | + | 810745 | 811500 | bioC | b0777 |
| CDS | + | 811493 | 812170 | bioD | b0778 |
| CDS | + | 812749 | 814770 | uvrB | b0779 |
| CDS | − | 814862 | 815870 | ybhK | b0780 |
| CDS | + | 816267 | 817256 | moaA | b0781 |
| CDS | + | 817278 | 817790 | moaB | b0782 |
| CDS | + | 817793 | 818278 | moaC | b0783 |
| CDS | + | 818271 | 818516 | moaD | b0784 |
| CDS | + | 818518 | 818970 | moaE | b0785 |
| CDS | + | 819107 | 819811 | ybhL | b0786 |
| CDS | + | 820016 | 820729 | ybhM | b0787 |
| CDS | − | 820765 | 821721 | ybhN | b0788 |
| CDS | − | 821721 | 822962 | ybhO | b0789 |
| CDS | − | 822959 | 823720 | ybhP | b0790 |
| CDS | + | 823853 | 824263 | ybhQ | b0791 |
| CDS | − | 824225 | 825331 | ybhR | b0792 |
| CDS | − | 825342 | 826475 | ybhS | b0793 |
| CDS | − | 826468 | 828204 | ybhF | b0794 |
| CDS | − | 828197 | 829195 | ybhG | b0795 |
| CDS | − | 829195 | 829866 | ybiH | b0796 |
| CDS | + | 830095 | 831459 | rhlE | b0797 |
| CDS | − | 831691 | 832173 | ybiA | b0798 |
| CDS | + | 832293 | 834443 | dinG | b0799 |
| CDS | + | 834471 | 835433 | ybiB | b0800 |
| CDS | + | 835574 | 836659 | ybiC | b0801 |
| CDS | − | 836888 | 837148 | ybiJ | b0802 |
| CDS | − | 837413 | 837679 | ybiI | b0803 |
| CDS | − | 837753 | 838430 | ybiX | b0804 |
| CDS | − | 838472 | 840754 | ybiL | b0805 |
| CDS | − | 841019 | 841279 | ybiM | b0806 |
| CDS | + | 841555 | 842481 | ybiN | b0807 |
| CDS | − | 842478 | 844703 | ybiO | b0808 |
| CDS | − | 844744 | 845686 | glnQ | b0809 |
| CDS | − | 845683 | 846342 | glnP | b0810 |
| CDS | − | 846481 | 847227 | glnH | b0811 |
| CDS | − | 847631 | 848134 | dps | b0812 |
| CDS | − | 848433 | 849320 | ybiF | b0813 |
| CDS | + | 849673 | 850188 | ompX | b0814 |
| CDS | − | 850237 | 851820 | ybiP | b0815 |
| CDS | + | 851894 | 852163 |  | b0816 |
| CDS | − | 852406 | 852873 | mntR | b0817 |
| CDS | + | 852870 | 853988 | ybiR | b0818 |
| CDS | − | 854047 | 854967 | ybiS | b0819 |
| CDS | + | 855186 | 856778 | ybiT | b0820 |
| CDS | − | 857019 | 858284 | ybiU | b0821 |
| CDS | − | 858436 | 859251 | ybiV | b0822 |
| CDS | − | 859397 | 861829 | ybiW | b0823 |
| CDS | − | 861835 | 862761 | ybiY | b0824 |
| CDS | + | 862865 | 863527 | fsa | b0825 |
| CDS | − | 863603 | 864352 | moeB | b0826 |
| CDS | − | 864352 | 865587 | moeA | b0827 |
| CDS | + | 865791 | 866756 | ybiK | b0828 |
| CDS | + | 866776 | 868614 | yliA | b0829 |
| CDS | + | 868634 | 870172 | yliB | b0830 |
| CDS | + | 870190 | 871110 | yliC | b0831 |
| CDS | + | 871113 | 872024 | yliD | b0832 |
| CDS | + | 872202 | 874550 | yliE | b0833 |
| CDS | + | 874558 | 875886 | yliF | b0834 |
| CDS | − | 875933 | 877258 | yliG | b0835 |
| CDS | + | 877471 | 877854 | yliH | b0836 |
| CDS | + | 877965 | 879080 | yliI | b0837 |
| CDS | − | 879077 | 879703 | yliJ | b0838 |
| CDS | + | 879950 | 881152 | dacC | b0839 |

TABLE 1-continued

| Type | S | Left | Right | Name | B |
|---|---|---|---|---|---|
| CDS | − | 881199 | 881957 | deoR | b0840 |
| CDS | − | 882015 | 882611 | ybjG | b0841 |
| CDS | + | 882896 | 884128 | cmr | b0842 |
| CDS | − | 884169 | 884453 | ybjH | b0843 |
| CDS | − | 884539 | 885354 | ybjI | b0844 |
| CDS | − | 885354 | 886562 | ybjJ | b0845 |
| CDS | + | 886646 | 887182 | ybjK | b0846 |
| CDS | − | 887357 | 889042 | ybjL | b0847 |
| CDS | + | 889312 | 889689 | ybjM | b0848 |
| CDS | − | 889719 | 889976 | grxA | b0849 |
| CDS | + | 890136 | 890423 | ybjC | b0850 |
| CDS | + | 890407 | 891129 | nfsA | b0851 |
| CDS | + | 891190 | 892092 | rimK | b0852 |
| CDS | + | 892180 | 892656 | ybjN | b0853 |
| CDS | + | 893007 | 894119 | potF | b0854 |
| CDS | + | 894214 | 895347 | potG | b0855 |
| CDS | + | 895357 | 896310 | potH | b0856 |
| CDS | + | 896307 | 897152 | potI | b0857 |
| CDS | + | 897212 | 897700 | ybjO | b0858 |
| CDS | + | 897741 | 898868 | ybjF | b0859 |
| CDS | − | 899067 | 899798 | artJ | b0860 |
| CDS | − | 900089 | 900757 | artM | b0861 |
| CDS | − | 900757 | 901473 | artQ | b0862 |
| CDS | − | 901480 | 902211 | artI | b0863 |
| CDS | − | 902229 | 902957 | artP | b0864 |
| CDS | − | 903175 | 903690 | ybjP | b0865 |
| CDS | + | 903816 | 904139 | ybjQ | b0866 |
| CDS | + | 904136 | 904966 | ybjR | b0867 |
| CDS | − | 904963 | 905976 | ybjS | b0868 |
| CDS | − | 906075 | 907505 | ybjT | b0869 |
| CDS | − | 907516 | 908517 | ltaE | b0870 |
| CDS | − | 908554 | 910272 | poxB | b0871 |
| CDS | − | 910405 | 911373 | hcr | b0872 |
| CDS | − | 911385 | 913037 | hcp | b0873 |
| CDS | − | 913181 | 914080 | ybjE | b0874 |
| CDS | − | 914575 | 915270 | aqpZ | b0875 |
| CDS | + | 915696 | 917354 | ybjD | b0876 |
| CDS | − | 917351 | 918343 | ybjX | b0877 |
| CDS | + | 918458 | 919573 | macA | b0878 |
| CDS | + | 919570 | 921516 | macB | b0879 |
| CDS | − | 921589 | 921813 | cspD | b0880 |
| CDS | + | 922136 | 922456 | yljA | b0881 |
| CDS | + | 922487 | 924763 | clpA | b0882 |
| tRNA | − | 925107 | 925194 | serW | b0883 |
| CDS | − | 925448 | 925666 | infA | b0884 |
| CDS | − | 925951 | 926655 | aat | b0885 |
| CDS | − | 926697 | 928418 | cydC | b0886 |
| CDS | − | 928419 | 930185 | cydD | b0887 |
| CDS | − | 930308 | 931273 | trxB | b0888 |
| CDS | + | 931818 | 932312 | lrp | b0889 |
| CDS | + | 932447 | 936436 | ftsK | b0890 |
| CDS | + | 936592 | 937206 | lolA | b0891 |
| CDS | + | 937217 | 938560 | ycaJ | b0892 |
| CDS | + | 938651 | 939943 | serS | b0893 |
| CDS | + | 940182 | 942626 | dmsA | b0894 |
| CDS | + | 942637 | 943254 | dmsB | b0895 |
| CDS | + | 943256 | 944119 | dmsC | b0896 |
| CDS | − | 944154 | 944780 | ycaC | b0897 |
| CDS | + | 945094 | 946242 | ycaD | b0898 |
| CDS | + | 946452 | 947882 | ycaM | b0899 |
| CDS | − | 947883 | 948791 | ycaN | b0900 |
| CDS | + | 948891 | 949481 | ycaK | b0901 |
| CDS | − | 949563 | 950303 | pflA | b0902 |
| CDS | − | 950495 | 952777 | pflB | b0903 |
| CDS | − | 952832 | 953689 | focA | b0904 |
| CDS | − | 954095 | 955855 | ycaO | b0905 |
| CDS | + | 955985 | 956677 | ycaP | b0906 |
| CDS | + | 956876 | 957964 | serC | b0907 |
| CDS | + | 958035 | 959318 | aroA | b0908 |
| CDS | + | 959487 | 960251 | ycaL | b0909 |
| CDS | + | 960424 | 961107 | cmk | b0910 |
| CDS | + | 961218 | 962891 | rpsA | b0911 |
| CDS | + | 963051 | 963335 | himD | b0912 |
| CDS | + | 963543 | 965807 | ycaI | b0913 |
| CDS | + | 965844 | 967592 | msbA | b0914 |
| CDS | + | 967589 | 968575 | lpxK | b0915 |
| CDS | + | 968612 | 969844 | ycaQ | b0916 |
| CDS | + | 969896 | 970078 | ycaR | b0917 |
| CDS | + | 970075 | 970821 | kdsB | b0918 |
| CDS | + | 970975 | 971868 | ycbJ | b0919 |
| CDS | − | 971845 | 972624 | ycbC | b0920 |
| CDS | + | 972760 | 973545 | smtA | b0921 |
| CDS | + | 973542 | 974864 | mukF | b0922 |
| CDS | + | 974872 | 975549 | mukE | b0923 |
| CDS | + | 975549 | 980009 | mukB | b0924 |
| CDS | + | 980270 | 982117 | ycbB | b0925 |
| CDS | + | 982298 | 982846 | ycbK | b0926 |
| CDS | + | 982873 | 983520 | ycbL | b0927 |
| CDS | − | 983742 | 984932 | aspC | b0928 |
| CDS | − | 985117 | 986205 | ompF | b0929 |
| CDS | − | 986808 | 988208 | asnS | b0930 |
| CDS | − | 988377 | 989579 | pncB | b0931 |
| CDS | + | 989845 | 992457 | pepN | b0932 |
| CDS | − | 992500 | 993267 | ssuB | b0933 |
| CDS | − | 993264 | 994055 | ssuC | b0934 |
| CDS | − | 994066 | 995211 | ssuD | b0935 |
| CDS | − | 995208 | 996167 | ssuA | b0936 |
| CDS | − | 996160 | 996735 | ssuE | b0937 |
| CDS | + | 997091 | 997630 | ycbQ | b0938 |
| CDS | + | 997713 | 998414 | ycbR | b0939 |
| CDS | − | 998439 | 1001039 | ycbS | b0940 |
| CDS | + | 1001030 | 1002100 | ycbT | b0941 |
| CDS | + | 1002112 | 1002654 | ycbU | b0942 |
| CDS | + | 1002662 | 1003177 | ycbV | b0943 |
| CDS | + | 1003170 | 1003880 | ycbF | b0944 |
| CDS | + | 1003991 | 1005001 | pyrD | b0945 |
| CDS | + | 1005175 | 1005717 | ycbW | b0946 |
| CDS | − | 1005714 | 1006823 | ycbX | b0947 |
| CDS | + | 1007067 | 1009175 | ycbY | b0948 |
| CDS | + | 1009187 | 1011094 | uup | b0949 |
| CDS | + | 1011224 | 1012477 | pqiA | b0950 |
| CDS | + | 1012482 | 1014122 | pqiB | b0951 |
| CDS | + | 1014134 | 1014682 | ymbA | b0952 |
| CDS | + | 1014938 | 1015105 | rmf | b0953 |
| CDS | − | 1015175 | 1015693 | fabA | b0954 |
| CDS | − | 1015762 | 1017522 | ycbZ | b0955 |
| CDS | + | 1017708 | 1018160 | ycbG | b0956 |
| CDS | − | 1018236 | 1019276 | ompA | b0957 |
| CDS | − | 1019633 | 1020142 | sulA | b0958 |
| CDS | + | 1020361 | 1020990 | yccR | b0959 |
| CDS | − | 1020953 | 1023106 | yccS | b0960 |
| CDS | − | 1023125 | 1023571 | yccF | b0961 |
| CDS | + | 1023694 | 1025748 | helD | b0962 |
| CDS | − | 1025780 | 1026238 | mgsA | b0963 |
| CDS | − | 1026334 | 1026996 | yccT | b0964 |
| CDS | + | 1027169 | 1027582 | yccU | b0965 |
| CDS | − | 1027627 | 1027995 | yccV | b0966 |
| CDS | − | 1028002 | 1029105 | yccW | b0967 |
| CDS | + | 1029287 | 1029565 | yccX | b0968 |
| CDS | − | 1029562 | 1029891 | yccK | b0969 |
| CDS | − | 1029982 | 1030641 | yccA | b0970 |
| tRNA | − | 1030848 | 1030935 | serT | b0971 |
| CDS | + | 1031362 | 1032480 | hyaA | b0972 |
| CDS | + | 1032477 | 1034270 | hyaB | b0973 |
| CDS | + | 1034289 | 1034996 | hyaC | b0974 |
| CDS | + | 1034993 | 1035580 | hyaD | b0975 |
| CDS | + | 1035577 | 1035975 | hyaE | b0976 |
| CDS | + | 1035972 | 1036829 | hyaF | b0977 |
| CDS | + | 1036963 | 1038507 | appC | b0978 |
| CDS | + | 1038519 | 1039655 | appB | b0979 |
| CDS | + | 1039840 | 1041138 | appA | b0980 |
| CDS | − | 1041253 | 1043433 | yccC | b0981 |
| CDS | − | 1043453 | 1043899 | yccY | b0982 |
| CDS | − | 1043887 | 1045026 | yccZ | b0983 |
| CDS | + | 1045072 | 1047168 | ymcA | b0984 |
| CDS | − | 1047168 | 1047914 | ymcB | b0985 |
| CDS | − | 1047911 | 1048555 | ymcC | b0986 |
| CDS | − | 1048662 | 1048967 | ymcD | b0987 |
| repeat_region | + | 1049001 | 1049768 | | |
| CDS | + | 1049250 | 1049753 | insB_4 | b0988 |
| CDS | − | 1050186 | 1050398 | cspH | b0989 |
| CDS | − | 1050684 | 1050896 | cspG | b0990 |
| CDS | + | 1051070 | 1051300 | sfa | b0991 |
| CDS | − | 1051512 | 1052585 | yccM | b0992 |
| CDS | − | 1052657 | 1055401 | torT | b0993 |
| CDS | + | 1055484 | 1056512 | torT | b0994 |

TABLE 1-continued

| Type | S | Left | Right | Name | B |
|---|---|---|---|---|---|
| CDS | − | 1056485 | 1057177 | torR | b0995 |
| CDS | + | 1057307 | 1058479 | torC | b0996 |
| CDS | + | 1058479 | 1061025 | torA | b0997 |
| CDS | + | 1061022 | 1061621 | torD | b0998 |
| CDS | − | 1061773 | 1062078 | yccD | b0999 |
| CDS | − | 1062078 | 1062998 | cbpA | b1000 |
| CDS | − | 1063259 | 1064515 | yccE | b1001 |
| CDS | + | 1064808 | 1066049 | agp | b1002 |
| CDS | − | 1066087 | 1066314 | yccJ | b1003 |
| CDS | − | 1066335 | 1066931 | wrbA | b1004 |
| CDS | + | 1067141 | 1067371 | ycdF | b1005 |
| CDS | − | 1067734 | 1069062 | ycdG | b1006 |
| CDS | − | 1069083 | 1069577 | ycdH | b1007 |
| CDS | − | 1069588 | 1070178 | ycdI | b1008 |
| CDS | − | 1070188 | 1070988 | ycdJ | b1009 |
| CDS | − | 1070996 | 1071382 | ycdK | b1010 |
| CDS | − | 1071394 | 1072086 | ycdL | b1011 |
| CDS | − | 1072086 | 1073234 | ycdM | b1012 |
| CDS | + | 1073465 | 1074103 | ycdC | b1013 |
| CDS | + | 1074143 | 1078105 | putA | b1014 |
| CDS | + | 1078528 | 1080036 | putP | b1015 |
| CDS | + | 1080579 | 1080689 | ycdN_1 | b1016 |
| CDS | + | 1080677 | 1081408 | ycdN_2 | b1017 |
| CDS | + | 1081466 | 1082593 | ycdO | b1018 |
| CDS | + | 1082599 | 1083870 | ycdB | b1019 |
| CDS | + | 1084215 | 1085279 | phoH | b1020 |
| CDS | − | 1085329 | 1085742 | ycdP | b1021 |
| CDS | − | 1085744 | 1087069 | ycdQ | b1022 |
| CDS | − | 1087062 | 1089080 | ycdR | b1023 |
| CDS | − | 1089089 | 1091512 | ycdS | b1024 |
| CDS | + | 1092099 | 1093457 | ycdT | b1025 |
| repeat_region | − | 1093468 | 1094725 | | |
| CDS | − | 1093498 | 1094364 | tra5_3 | b1026 |
| CDS | − | 1094361 | 1094669 | | b1027 |
| CDS | + | 1094767 | 1095069 | | b1028 |
| CDS | + | 1095066 | 1096052 | ycdU | b1029 |
| tRNA | − | 1096788 | 1096875 | serX | b1032 |
| CDS | + | 1097109 | 1098047 | ycdW | b1033 |
| CDS | + | 1098102 | 1098839 | ycdX | b1034 |
| CDS | + | 1098863 | 1099417 | ycdY | b1035 |
| CDS | + | 1099519 | 1100010 | ycdZ | b1036 |
| CDS | − | 1100074 | 1100907 | csgG | b1037 |
| CDS | − | 1100934 | 1101350 | csgF | b1038 |
| CDS | − | 1101375 | 1101764 | csgE | b1039 |
| CDS | − | 1101769 | 1102419 | csgD | b1040 |
| CDS | + | 1103174 | 1103629 | csgB | b1041 |
| CDS | + | 1103670 | 1104125 | csgA | b1042 |
| CDS | + | 1104184 | 1104516 | csgC | b1043 |
| CDS | + | 1104637 | 1104948 | ymdA | b1044 |
| CDS | + | 1105043 | 1105576 | ymdB | b1045 |
| CDS | + | 1105578 | 1106999 | ymdC | b1046 |
| CDS | − | 1107007 | 1108164 | mdoC | b1047 |
| CDS | + | 1108558 | 1110093 | mdoG | b1048 |
| CDS | + | 1110086 | 1112629 | mdoH | b1049 |
| CDS | + | 1112802 | 1113029 | yceK | b1050 |
| CDS | − | 1113030 | 1113404 | msyB | b1051 |
| CDS | − | 1113434 | 1113532 | | b1052 |
| CDS | − | 1113487 | 1114713 | yceE | b1053 |
| CDS | − | 1114885 | 1115805 | htrB | b1054 |
| CDS | + | 1116030 | 1117082 | yceA | b1055 |
| CDS | − | 1117124 | 1117699 | yceI | b1056 |
| CDS | − | 1117703 | 1118269 | yceJ | b1057 |
| CDS | − | 1118530 | 1118670 | yceO | b1058 |
| CDS | − | 1118691 | 1119809 | solA | b1059 |
| CDS | − | 1119924 | 1120178 | yceP | b1060 |
| CDS | − | 1120465 | 1120710 | dinI | b1061 |
| CDS | − | 1120784 | 1121830 | pyrC | b1062 |
| CDS | − | 1121936 | 1122496 | yceB | b1063 |
| CDS | − | 1122630 | 1123277 | grxB | b1064 |
| CDS | − | 1123341 | 1124549 | yceL | b1065 |
| CDS | + | 1124785 | 1125369 | rimJ | b1066 |
| CDS | + | 1125380 | 1126027 | yceH | b1067 |
| CDS | + | 1126029 | 1126952 | mviM | b1068 |
| CDS | + | 1127062 | 1128597 | mviN | b1069 |
| CDS | − | 1128637 | 1129053 | flgN | b1070 |
| CDS | − | 1129058 | 1129351 | flgM | b1071 |
| CDS | − | 1129427 | 1130086 | flgA | b1072 |
| CDS | + | 1130241 | 1130657 | flgB | b1073 |
| CDS | + | 1130661 | 1131065 | flgC | b1074 |
| CDS | + | 1131077 | 1131772 | flgD | b1075 |
| CDS | + | 1131797 | 1133005 | flgE | b1076 |
| CDS | + | 1133025 | 1133780 | flgF | b1077 |
| CDS | + | 1133952 | 1134734 | flgG | b1078 |
| CDS | + | 1134787 | 1135485 | flgH | b1079 |
| CDS | + | 1135497 | 1136594 | flgI | b1080 |
| CDS | + | 1136594 | 1137535 | flgJ | b1081 |
| CDS | + | 1137601 | 1139244 | flgK | b1082 |
| CDS | + | 1139256 | 1140209 | flgL | b1083 |
| CDS | − | 1140405 | 1143590 | rne | b1084 |
| CDS | − | 1143725 | 1144045 | | b1085 |
| CDS | + | 1144163 | 1145122 | rluC | b1086 |
| CDS | − | 1145234 | 1145818 | yceF | b1087 |
| CDS | − | 1146017 | 1146538 | yceD | b1088 |
| CDS | + | 1146590 | 1146763 | rpmF | b1089 |
| CDS | + | 1146844 | 1147914 | plsX | b1090 |
| CDS | + | 1147982 | 1148935 | fabH | b1091 |
| CDS | + | 1148951 | 1149880 | fabD | b1092 |
| CDS | + | 1149893 | 1150627 | fabG | b1093 |
| CDS | + | 1150838 | 1151074 | acpP | b1094 |
| CDS | + | 1151162 | 1152403 | fabF | b1095 |
| CDS | + | 1152523 | 1153332 | pabC | b1096 |
| CDS | + | 1153335 | 1154357 | yceG | b1097 |
| CDS | + | 1154347 | 1154988 | tmk | b1098 |
| CDS | + | 1154985 | 1155989 | holB | b1099 |
| CDS | + | 1156000 | 1156797 | ycfH | b1100 |
| CDS | + | 1157092 | 1158525 | ptsG | b1101 |
| CDS | − | 1158585 | 1160774 | fhuE | b1102 |
| CDS | + | 1161108 | 1161467 | ycfF | b1103 |
| CDS | + | 1161470 | 1161847 | ycfL | b1104 |
| CDS | + | 1161861 | 1162502 | ycfM | b1105 |
| CDS | + | 1162483 | 1163307 | ycfN | b1106 |
| CDS | + | 1163318 | 1164343 | nagZ | b1107 |
| CDS | + | 1164366 | 1164908 | ycfP | b1108 |
| CDS | + | 1165308 | 1166612 | ndh | b1109 |
| CDS | + | 1166822 | 1167361 | ycfJ | b1110 |
| CDS | − | 1167423 | 1168055 | ycfQ | b1011 |
| CDS | + | 1168296 | 1168553 | ycfR | b1112 |
| CDS | − | 1168635 | 1169597 | ycfS | b1113 |
| CDS | − | 1169741 | 1173187 | mfd | b1114 |
| CDS | − | 1173315 | 1174388 | ycfT | b1115 |
| CDS | + | 1174650 | 1175849 | ycfU | b1116 |
| CDS | + | 1175842 | 1176543 | ycfV | b1117 |
| CDS | + | 1176543 | 1177787 | ycfW | b1118 |
| CDS | + | 1177816 | 1178727 | ycfX | b1119 |
| CDS | + | 1178743 | 1179582 | cobB | b1120 |
| CDS | − | 1179740 | 1180490 | ycfZ | b1121 |
| CDS | − | 1180487 | 1180948 | ymfA | b1122 |
| CDS | − | 1181006 | 1182052 | potD | b1123 |
| CDS | − | 1182049 | 1182843 | potC | b1124 |
| CDS | − | 1182840 | 1183667 | potB | b1125 |
| CDS | − | 1183681 | 1184817 | potA | b1126 |
| CDS | + | 1185067 | 1186293 | pepT | b1127 |
| CDS | − | 1186342 | 1187463 | ycfD | b1128 |
| CDS | + | 1187539 | 1188999 | phoQ | b1129 |
| CDS | + | 1188999 | 1189670 | phoP | b1130 |
| CDS | − | 1189839 | 1191209 | purB | b1131 |
| CDS | − | 1191213 | 1191854 | ycfC | b1132 |
| CDS | − | 1191890 | 1192996 | trmU | b1133 |
| CDS | − | 1193050 | 1193511 | ymfB | b1134 |
| CDS | − | 1193521 | 1194174 | ymfC | b1135 |
| CDS | + | 1194346 | 1195596 | icdA | b1136 |
| CDS | − | 1196090 | 1196755 | ymfD | b1137 |
| CDS | − | 1196756 | 1197460 | ymfE | b1138 |
| CDS | + | 1197918 | 1198811 | lit | b1139 |
| CDS | + | 1198902 | 1200029 | intE | b1140 |
| CDS | − | 1200010 | 1200255 | | b1141 |
| CDS | − | 1200292 | 1200603 | | b1142 |
| CDS | + | 1200720 | 1201061 | ymfI | b1143 |
| CDS | + | 1200999 | 1201307 | ymfJ | b1144 |
| CDS | − | 1201482 | 1202156 | ymfK | b1145 |
| CDS | − | 1202247 | 1202447 | | b1146 |
| CDS | + | 1202479 | 1203048 | ymfL | b1147 |
| CDS | + | 1203045 | 1203383 | ymfM | b1148 |
| CDS | + | 1203393 | 1204760 | ymfN | b1149 |
| CDS | + | 1204772 | 1204954 | ymfR | b1150 |
| CDS | + | 1204954 | 1205427 | ymfO | b1151 |

TABLE 1-continued

| Type | S | Left | Right | Name | B |
|------|---|------|-------|------|---|
| CDS | + | 1205483 | 1206145 | ymfP | b1152 |
| CDS | + | 1206136 | 1206720 | ymfQ | b1153 |
| CDS | + | 1206724 | 1207353 | ycfK | b1154 |
| CDS | + | 1207355 | 1207768 | ymfS | b1155 |
| CDS | − | 1207740 | 1208342 | tfaE | b1156 |
| CDS | − | 1208342 | 1208878 | stfE | b1157 |
| CDS | + | 1208908 | 1209462 | pin | b1158 |
| CDS | + | 1209569 | 1210402 | mcrA | b1159 |
| CDS | − | 1210903 | 1211226 | ycgW | b1160 |
| CDS | − | 1211926 | 1212330 | ycgX | b1161 |
| CDS | − | 1212551 | 1213282 | ycgE | b1162 |
| CDS | − | 1213487 | 1214698 | ycgF | b1163 |
| CDS | + | 1215012 | 1215248 | ycgZ | b1164 |
| CDS | + | 1215291 | 1215563 | ymgA | b1165 |
| CDS | + | 1215592 | 1215858 | ymgB | b1166 |
| CDS | + | 1215971 | 1216219 | ymgC | b1167 |
| CDS | + | 1216551 | 1218074 | ycgG | b1168 |
| CDS | + | 1220024 | 1220344 | ycgH_1 | b1169 |
| CDS | + | 1220429 | 1221445 | ycgH_2 | b1170 |
| CDS | − | 1221528 | 1221857 | ymgD | b1171 |
| CDS | − | 1221867 | 1222142 |  | b1172 |
| CDS | + | 1222918 | 1223130 |  | b1173 |
| CDS | − | 1223502 | 1223768 | minE | b1174 |
| CDS | − | 1223772 | 1224584 | minD | b1175 |
| CDS | − | 1224608 | 1225303 | minC | b1176 |
| CDS | + | 1225823 | 1226191 | ycgJ | b1177 |
| CDS | − | 1226294 | 1226695 | ycgK | b1178 |
| CDS | + | 1226904 | 1227230 | ycgL | b1179 |
| CDS | + | 1227302 | 1227961 | ycgM | b1180 |
| CDS | + | 1228053 | 1228499 | ycgN | b1181 |
| CDS | − | 1228706 | 1229617 | hlyE | b1182 |
| CDS | + | 1229990 | 1230409 | umuD | b1183 |
| CDS | + | 1230409 | 1231677 | umuC | b1184 |
| CDS | − | 1231723 | 1232253 | dsbB | b1185 |
| CDS | − | 1232399 | 1233940 | nhaB | b1186 |
| CDS | + | 1234161 | 1234880 | fadR | b1187 |
| CDS | − | 1234932 | 1236464 | ycgB | b1188 |
| CDS | + | 1236794 | 1238092 | dadA | b1189 |
| CDS | + | 1238102 | 1239172 | dadX | b1190 |
| CDS | − | 1239558 | 1241294 | ycgO | b1191 |
| CDS | − | 1241389 | 1242303 | ldcA | b1192 |
| CDS | + | 1242403 | 1243014 | mltE | b1193 |
| CDS | − | 1243016 | 1243750 | ycgR | b1194 |
| CDS | − | 1243951 | 1244205 | ymgE | b1195 |
| CDS | + | 1244383 | 1244823 | ycgY | b1196 |
| CDS | − | 1244902 | 1246599 | treA | b1197 |
| CDS | − | 1246919 | 1248337 | dhaM | b1198 |
| CDS | − | 1248348 | 1248980 | dhaL | b1199 |
| CDS | − | 1248991 | 1250061 | dhaK | b1200 |
| CDS | + | 1250289 | 1252208 | dhaR | b1201 |
| CDS | − | 1252308 | 1255175 | ycgV | b1202 |
| CDS | − | 1255944 | 1257035 | ychF | b1203 |
| CDS | − | 1257152 | 1257736 | pth | b1204 |
| CDS | + | 1258014 | 1258292 | ychH | b1205 |
| CDS | − | 1258347 | 1260026 | ychM | b1206 |
| CDS | − | 1260151 | 1261098 | prsA | b1207 |
| CDS | − | 1261249 | 1262100 | ispE | b1208 |
| CDS | − | 1262100 | 1262723 | hemM | b1209 |
| CDS | + | 1262937 | 1264193 | hemA | b1210 |
| CDS | + | 1264235 | 1265317 | prfA | b1211 |
| CDS | + | 1265317 | 1266110 | hemK | b1212 |
| CDS | + | 1266147 | 1266539 | ychQ | b1213 |
| CDS | + | 1266543 | 1267352 | ychA | b1214 |
| CDS | + | 1267388 | 1268242 | kdsA | b1215 |
| CDS | − | 1269074 | 1271072 | chaA | b1216 |
| CDS | + | 1271342 | 1271572 | chaB | b1217 |
| CDS | + | 1271709 | 1272425 | chaC | b1218 |
| CDS | − | 1272469 | 1272822 | ychN | b1219 |
| CDS | + | 1273148 | 1274401 | ychP | b1220 |
| CDS | − | 1274402 | 1275052 | narL | b1221 |
| CDS | − | 1275045 | 1276841 | narX | b1222 |
| CDS | + | 1277180 | 1278571 | narK | b1223 |
| CDS | + | 1279087 | 1282830 | narG | b1224 |
| CDS | + | 1282827 | 1284365 | narH | b1225 |
| CDS | + | 1284362 | 1285072 | narJ | b1226 |
| CDS | + | 1285072 | 1285749 | narI | b1227 |
| CDS | + | 1285932 | 1286207 |  | b1228 |
| CDS | − | 1286310 | 1286411 | tpr | b1229 |
| tRNA | − | 1286467 | 1286551 | tyrV | b1230 |
| tRNA | − | 1286761 | 1286845 | tyrT | b1231 |
| CDS | − | 1287005 | 1287847 | purU | b1232 |
| CDS | − | 1287897 | 1288355 | ychJ | b1233 |
| CDS | + | 1288429 | 1289373 | ychK | b1234 |
| CDS | + | 1289465 | 1290478 | hnr | b1235 |
| CDS | + | 1290680 | 1291588 | galU | b1236 |
| CDS | − | 1291732 | 1292145 | hns | b1237 |
| CDS | + | 1292750 | 1293367 | tdk | b1238 |
| CDS | − | 1293649 | 1294239 | ychG | b1239 |
| CDS | − | 1294191 | 1294421 |  | b1240 |
| CDS | − | 1294669 | 1297344 | adhE | b1241 |
| CDS | + | 1297821 | 1298468 | ychE | b1242 |
| CDS | + | 1299206 | 1300837 | oppA | b1243 |
| CDS | + | 1300923 | 1301843 | oppB | b1244 |
| CDS | + | 1301858 | 1302766 | oppC | b1245 |
| CDS | + | 1302778 | 1303791 | oppD | b1246 |
| CDS | + | 1303788 | 1304792 | oppF | b1247 |
| CDS | − | 1304845 | 1305174 | yciU | b1248 |
| CDS | − | 1305209 | 1306669 | cls | b1249 |
| CDS | − | 1307040 | 1308293 | kch | b1250 |
| CDS | − | 1308593 | 1308889 | yciI | b1251 |
| CDS | + | 1309113 | 1309832 | tonB | b1252 |
| CDS | + | 1309872 | 1310270 | yciA | b1253 |
| CDS | − | 1310375 | 1310914 | ispZ | b1254 |
| CDS | − | 1310944 | 1311687 | yciC | b1255 |
| CDS | + | 1312044 | 1312682 | yciD | b1256 |
| CDS | + | 1312742 | 1313248 | yciE | b1257 |
| CDS | − | 1313294 | 1313794 | yciF | b1258 |
| CDS | − | 1313880 | 1314059 | yciG | b1259 |
| CDS | − | 1314440 | 1315246 | trpA | b1260 |
| CDS | − | 1315246 | 1316439 | trpB | b1261 |
| CDS | − | 1316451 | 1317809 | trpC | b1262 |
| CDS | − | 1317813 | 1319408 | trpD | b1263 |
| CDS | − | 1319408 | 1320970 | trpE | b1264 |
| CDS | − | 1321062 | 1321106 | trpL | b1265 |
| CDS | + | 1321244 | 1322125 | yciV | b1266 |
| CDS | + | 1322122 | 1322742 | yciO | b1267 |
| CDS | + | 1322770 | 1324665 | yciQ | b1268 |
| CDS | + | 1324876 | 1325751 | yciL | b1269 |
| CDS | − | 1325791 | 1326381 | btuR | b1270 |
| CDS | − | 1326378 | 1327136 | yciK | b1271 |
| CDS | + | 1327356 | 1328405 | sohB | b1272 |
| CDS | − | 1328441 | 1328692 | yciN | b1273 |
| CDS | + | 1329072 | 1331669 | topA | b1274 |
| CDS | + | 1331879 | 1332853 | cysB | b1275 |
| CDS | + | 1333855 | 1336530 | acnA | b1276 |
| CDS | − | 1336594 | 1337184 | ribA | b1277 |
| CDS | + | 1337354 | 1338118 | pgpB | b1278 |
| CDS | + | 1338267 | 1338575 | yciS | b1279 |
| CDS | + | 1338582 | 1339751 | yciM | b1280 |
| CDS | + | 1339945 | 1340682 | pyrF | b1281 |
| CDS | + | 1340682 | 1341008 | yciH | b1282 |
| CDS | − | 1341134 | 1341352 | osmB | b1283 |
| CDS | − | 1341621 | 1342370 | yciT | b1284 |
| CDS | − | 1342781 | 1344766 | yciR | b1285 |
| CDS | − | 1345002 | 1346936 | rnb | b1286 |
| CDS | − | 1347004 | 1348131 | yciW | b1287 |
| CDS | − | 1348275 | 1349063 | fabI | b1288 |
| CDS | − | 1349431 | 1349784 | ycjD | b1289 |
| CDS | − | 1349852 | 1350658 | sapF | b1290 |
| CDS | − | 1350660 | 1351652 | sapD | b1291 |
| CDS | − | 1351652 | 1352542 | sapC | b1292 |
| CDS | − | 1352529 | 1353494 | sapB | b1293 |
| CDS | − | 1353491 | 1355134 | sapA | b1294 |
| CDS | − | 1355447 | 1355692 | ymjA | b1295 |
| CDS | − | 1355826 | 1357211 | ycjJ | b1296 |
| CDS | − | 1357514 | 1358932 | ycjK | b1297 |
| CDS | + | 1359144 | 1359908 | ycjL | b1298 |
| CDS | + | 1359935 | 1360492 | ycjC | b1299 |
| CDS | + | 1360767 | 1362254 | aldH | b1300 |
| CDS | + | 1362256 | 1363536 | ordL | b1301 |
| CDS | + | 1363574 | 1364839 | goaG | b1302 |
| CDS | − | 1364959 | 1365936 | pspF | b1303 |
| CDS | + | 1366103 | 1366771 | pspA | b1304 |
| CDS | + | 1366825 | 1367049 | pspB | b1305 |
| CDS | + | 1367049 | 1367408 | pspC | b1306 |
| CDS | + | 1367417 | 1367638 | pspD | b1307 |

TABLE 1-continued

| Type | S | Left | Right | Name | B |
|---|---|---|---|---|---|
| CDS | + | 1367713 | 1368027 | pspE | b1308 |
| CDS | + | 1368240 | 1369919 | ycjN | b1309 |
| CDS | + | 1369933 | 1371225 | ycjN | b1310 |
| CDS | + | 1371246 | 1372127 | ycjO | b1311 |
| CDS | + | 1372114 | 1372956 | ycjP | b1312 |
| CDS | + | 1372987 | 1374039 | ycjQ | b1313 |
| CDS | + | 1374058 | 1374846 | ycjR | b1314 |
| CDS | + | 1374856 | 1375911 | ycjS | b1315 |
| CDS | + | 1375908 | 1378175 | ycjT | b1316 |
| CDS | + | 1378172 | 1378831 | ycjU | b1317 |
| CDS | + | 1378845 | 1379813 | ycjV | b1318 |
| CDS | + | 1379971 | 1380876 | ompG | b1319 |
| CDS | − | 1380987 | 1381985 | ycjW | b1320 |
| CDS | + | 1382141 | 1383538 | ycjX | b1321 |
| CDS | + | 1383535 | 1384596 | ycjF | b1322 |
| CDS | + | 1384744 | 1386285 | tyrR | b1323 |
| CDS | − | 1386329 | 1386835 | tpx | b1324 |
| CDS | + | 1386954 | 1387919 | ycjG | b1325 |
| CDS | − | 1387894 | 1388682 | ycjI | b1326 |
| CDS | − | 1388957 | 1389889 | ycjY | b1327 |
| CDS | + | 1390015 | 1390914 | ycjZ | b1328 |
| CDS | + | 1391251 | 1392864 | mppA | b1329 |
| CDS | − | 1392915 | 1393946 | ynaI | b1330 |
| repeat_region | − | 1394068 | 1395262 | | |
| CDS | + | 1394100 | 1395116 | trs5_4 | b1331 |
| CDS | + | 1395389 | 1395646 | ynaJ | b1332 |
| CDS | − | 1395696 | 1396646 | ydaA | b1333 |
| CDS | − | 1396798 | 1397550 | fnr | b1334 |
| CDS | − | 1397745 | 1398260 | ogt | b1335 |
| CDS | − | 1398271 | 1399797 | abgT | b1336 |
| CDS | − | 1399834 | 1401279 | abgB | b1337 |
| CDS | − | 1401279 | 1402589 | abgA | b1338 |
| CDS | + | 1402765 | 1403673 | abgR | b1339 |
| CDS | + | 1404003 | 1404566 | ydaL | b1340 |
| CDS | − | 1404587 | 1405819 | ydaM | b1341 |
| CDS | + | 1406074 | 1407057 | ydaN | b1342 |
| CDS | + | 1407535 | 1408908 | dbpA | b1343 |
| CDS | − | 1409037 | 1409972 | ydaO | b1344 |
| CDS | − | 1410024 | 1411259 | intR | b1345 |
| CDS | − | 1411261 | 1411476 | xisR | b1346 |
| CDS | − | 1411555 | 1411764 | ydaC | b1347 |
| CDS | − | 1411757 | 1411951 | lar | b1348 |
| CDS | − | 1412008 | 1412817 | recT | b1349 |
| CDS | − | 1412810 | 1415410 | recE | b1350 |
| CDS | − | 1415512 | 1415787 | racC | b1351 |
| CDS | − | 1416032 | 1416253 | kil | b1352 |
| CDS | + | 1416695 | 1417183 | sieB | b1353 |
| CDS | + | 1417192 | 1417368 | | b1354 |
| CDS | − | 1417346 | 1417480 | ydaG | b1355 |
| CDS | − | 1417789 | 1418265 | racR | b1356 |
| CDS | + | 1418389 | 1418685 | ydaS | b1357 |
| CDS | + | 1418708 | 1419130 | ydaT | b1358 |
| CDS | + | 1419143 | 1420000 | ydaU | b1359 |
| CDS | + | 1420007 | 1420753 | ydaV | b1360 |
| CDS | + | 1420776 | 1421336 | ydaW | b1361 |
| CDS | + | 1421369 | 1421668 | rzpR | b1362 |
| CDS | + | 1421806 | 1423263 | trkG | b1363 |
| CDS | + | 1423202 | 1423483 | | b1364 |
| CDS | + | 1423401 | 1423664 | ynaK | b1365 |
| CDS | + | 1423645 | 1424004 | ydaY | b1366 |
| CDS | + | 1424079 | 1424312 | | b1367 |
| CDS | + | 1424478 | 1425506 | ynaA | b1368 |
| CDS | + | 1425482 | 1425637 | | b1369 |
| repeat_region | + | 1425623 | 1426818 | | |
| CDS | − | 1425770 | 1426750 | trs5_5 | b1370 |
| CDS | + | 1426838 | 1427008 | | b1371 |
| CDS | + | 1427073 | 1430435 | stfR | b1372 |
| CDS | + | 1430435 | 1431010 | tfaR | b1373 |
| CDS | − | 1431108 | 1431698 | pinR | b1374 |
| CDS | − | 1432015 | 1432281 | ynaE | b1375 |
| CDS | − | 1433209 | 1433643 | ynaF | b1376 |
| CDS | − | 1433784 | 1434917 | ompN | b1377 |
| CDS | − | 1435284 | 1438808 | ydbK | b1378 |
| CDS | − | 1439345 | 1439767 | hslJ | b1379 |
| CDS | − | 1439878 | 1440867 | ldhA | b1380 |
| CDS | + | 1441075 | 1443714 | ydbH | b1381 |
| CDS | + | 1443711 | 1443896 | ynbE | b1382 |
| CDS | + | 1443904 | 1444230 | ydbL | b1383 |
| CDS | − | 1444402 | 1445307 | feaR | b1384 |
| CDS | + | 1445543 | 1447042 | feaB | b1385 |
| CDS | + | 1447100 | 1449373 | tynA | b1386 |
| CDS | − | 1449621 | 1451666 | paaZ | b1387 |
| CDS | + | 1451951 | 1452880 | paaA | b1388 |
| CDS | + | 1452892 | 1453179 | paaB | b1389 |
| CDS | + | 1453188 | 1453934 | paaC | b1390 |
| CDS | + | 1453949 | 1454446 | paaD | b1391 |
| CDS | + | 1454454 | 1455524 | paaE | b1392 |
| CDS | + | 1455521 | 1456288 | paaF | b1393 |
| CDS | + | 1456288 | 1457076 | paaG | b1394 |
| CDS | + | 1457078 | 1458505 | paaH | b1395 |
| CDS | + | 1458495 | 1458917 | paaI | b1396 |
| CDS | + | 1458917 | 1460122 | paaJ | b1397 |
| CDS | + | 1460149 | 1461462 | paaK | b1398 |
| CDS | + | 1461563 | 1462513 | paaX | b1399 |
| CDS | + | 1462495 | 1463085 | paaY | b1400 |
| CDS | + | 1463416 | 1465974 | ydbA_1 | b1401 |
| repeat_region | + | 1465934 | 1467264 | | |
| CDS | − | 1465945 | 1466850 | yi22_2 | b1402 |
| CDS | − | 1466808 | 1467218 | yi21_2 | b1403 |
| repeat_region | + | 1467320 | 1468540 | | |
| CDS | + | 1467382 | 1468533 | tra8_2 | b1404 |
| CDS | + | 1468714 | 1472037 | ydbA_2 | b1405 |
| CDS | + | 1472245 | 1473105 | ydbC | b1406 |
| CDS | + | 1473168 | 1475474 | ydbD | b1407 |
| CDS | + | 1475645 | 1476250 | ynbA | b1408 |
| CDS | + | 1476250 | 1477146 | ynbB | b1409 |
| CDS | + | 1477162 | 1478919 | ynbC | b1410 |
| CDS | + | 1478933 | 1480225 | ynbD | b1411 |
| CDS | − | 1480279 | 1480884 | acpD | b1412 |
| CDS | + | 1481142 | 1484987 | hrpA | b1413 |
| CDS | + | 1485259 | 1486059 | ydcF | b1414 |
| CDS | + | 1486256 | 1487695 | aldA | b1415 |
| CDS | − | 1487737 | 1487988 | gapC_2 | b1416 |
| CDS | − | 1487985 | 1488737 | gapC_1 | b1417 |
| CDS | + | 1488926 | 1489456 | cybB | b1418 |
| CDS | + | 1489701 | 1489874 | ydcA | b1419 |
| CDS | + | 1489986 | 1490153 | mokB | b1420 |
| CDS | + | 1490494 | 1492134 | trg | b1421 |
| CDS | + | 1492172 | 1493095 | ydcI | b1422 |
| CDS | + | 1493312 | 1494655 | ydcJ | b1423 |
| CDS | + | 1494910 | 1496535 | ydcG | b1424 |
| CDS | − | 1496456 | 1496659 | | b1425 |
| CDS | + | 1496675 | 1496899 | ydcH | b1426 |
| CDS | + | 1496962 | 1497501 | rimL | b1427 |
| CDS | − | 1497493 | 1498473 | ydcK | b1428 |
| CDS | − | 1498597 | 1499589 | tehA | b1429 |
| CDS | + | 1499586 | 1500179 | tehB | b1430 |
| CDS | + | 1500481 | 1501149 | ydcL | b1431 |
| CDS | + | 1501681 | 1502889 | ydcM | b1432 |
| CDS | − | 1502929 | 1504104 | ydcO | b1433 |
| CDS | + | 1504196 | 1504732 | ydcN | b1434 |
| CDS | + | 1504805 | 1506766 | ydcP | b1435 |
| CDS | − | 1506858 | 1507088 | yncJ | b1436 |
| CDS | − | 1507274 | 1507471 | | b1437 |
| CDS | + | 1507511 | 1507948 | ydcQ | b1438 |
| CDS | + | 1508027 | 1509433 | ydcR | b1439 |
| CDS | + | 1509678 | 1510823 | ydcS | b1440 |
| CDS | + | 1510841 | 1511854 | ydcT | b1441 |
| CDS | + | 1511855 | 1512796 | ydcU | b1442 |
| CDS | + | 1512786 | 1513580 | ydcV | b1443 |
| CDS | + | 1513602 | 1515026 | ydcW | b1444 |
| CDS | + | 1515413 | 1515586 | ydcX | b1445 |
| CDS | + | 1515672 | 1515905 | ydcY | b1446 |
| CDS | − | 1515906 | 1516355 | ydcZ | b1447 |
| CDS | − | 1516352 | 1516870 | yncA | b1448 |
| CDS | + | 1517051 | 1518088 | yncB | b1449 |
| CDS | + | 1518286 | 1518951 | yncC | b1450 |
| CDS | − | 1518987 | 1521089 | yncD | b1451 |
| CDS | + | 1521331 | 1522392 | yncE | b1452 |
| CDS | − | 1522505 | 1524004 | ansP | b1453 |
| CDS | + | 1524271 | 1524888 | yncG | b1454 |
| CDS | + | 1524964 | 1525176 | yncH | b1455 |
| CDS | − | 1525914 | 1527962 | rhsE | b1456 |
| CDS | + | 1527946 | 1528428 | ydcD | b1457 |
| CDS | + | 1528610 | 1529356 | | b1458 |
| CDS | + | 1529400 | 1529600 | | b1459 |

TABLE 1-continued

| Type | S | Left | Right | Name | B |
|---|---|---|---|---|---|
| CDS | + | 1529840 | 1530976 | ydcC | b1460 |
| CDS | + | 1531076 | 1531309 | ydcE | b1461 |
| CDS | − | 1531306 | 1531875 | yddH | b1462 |
| CDS | + | 1532048 | 1532893 | nhoA | b1463 |
| CDS | − | 1532989 | 1533882 | yddE | b1464 |
| CDS | − | 1533961 | 1534641 | narV | b1465 |
| CDS | − | 1534638 | 1535333 | narW | b1466 |
| CDS | − | 1535333 | 1536877 | narY | b1467 |
| CDS | − | 1536874 | 1540614 | narZ | b1468 |
| CDS | − | 1540696 | 1542084 | narU | b1469 |
| CDS | − | 1542408 | 1542743 | yddJ | b1470 |
| CDS | − | 1542782 | 1543738 | yddK | b1471 |
| CDS | − | 1543762 | 1544052 |  | b1472 |
| CDS | − | 1544312 | 1545136 | yddG | b1473 |
| CDS | + | 1545425 | 1548472 | fdnG | b1474 |
| CDS | + | 1548485 | 1549369 | fdnH | b1475 |
| CDS | + | 1549362 | 1550015 | fdnI | b1476 |
| CDS | − | 1550422 | 1550784 | yddM | b1477 |
| CDS | − | 1550852 | 1551862 | adhP | b1478 |
| CDS | − | 1551996 | 1553693 | sfcA | b1479 |
| CDS | − | 1553850 | 1553987 | rpsV | b1480 |
| CDS | − | 1554089 | 1554304 | bdm | b1481 |
| CDS | + | 1554649 | 1555080 | osmC | b1482 |
| CDS | − | 1555136 | 1556062 | yddO | b1483 |
| CDS | − | 1556055 | 1557041 | yddP | b1484 |
| CDS | − | 1557038 | 1557934 | yddQ | b1485 |
| CDS | − | 1557931 | 1558953 | yddR | b1486 |
| CDS | − | 1558955 | 1560505 | yddS | b1487 |
| CDS | − | 1560519 | 1561100 | ddpX | b1488 |
| CDS | − | 1561358 | 1563757 | dos | b1489 |
| CDS | − | 1563782 | 1564825 | yddV | b1490 |
| CDS | − | 1565528 | 1566847 | yddW | b1491 |
| CDS | − | 1566978 | 1568513 | xasA | b1492 |
| CDS | − | 1568669 | 1570069 | gadB | b1493 |
| CDS | − | 1570431 | 1573226 | pqqL | b1494 |
| CDS | − | 1573271 | 1575643 | yddB | b1495 |
| CDS | − | 1575681 | 1577366 | yddA | b1496 |
| CDS | − | 1577657 | 1578814 | ydeM | b1497 |
| CDS | − | 1578866 | 1580548 | ydeN | b1498 |
| CDS | − | 1580950 | 1581711 | ydeO | b1499 |
| CDS | − | 1581786 | 1581983 |  | b1500 |
| CDS | − | 1582231 | 1584510 | ydeP | b1501 |
| CDS | − | 1584844 | 1585758 | ydeQ | b1502 |
| CDS | − | 1585817 | 1586320 | ydeR | b1503 |
| CDS | − | 1586333 | 1586863 | ydeS | b1504 |
| CDS | − | 1586877 | 1588025 | ydeT | b1505 |
| CDS | − | 1588381 | 1588560 |  | b1506 |
| CDS | − | 1588878 | 1590200 | hipA | b1507 |
| CDS | − | 1590200 | 1590466 | hipB | b1508 |
| CDS | − | 1590689 | 1592089 | ydeU | b1509 |
| CDS | − | 1592133 | 1596110 | ydeK | b1510 |
| CDS | − | 1596641 | 1598233 | ydeV | b1511 |
| CDS | − | 1598312 | 1599265 | ydeW | b1512 |
| CDS | + | 1599514 | 1601049 | ego | b1513 |
| CDS | + | 1601043 | 1602071 | ydeY | b1514 |
| CDS | + | 1602071 | 1603063 | ydeZ | b1515 |
| CDS | + | 1603075 | 1604097 | yneA | b1516 |
| CDS | + | 1604124 | 1604999 | yneB | b1517 |
| CDS | + | 1605023 | 1605313 | yneC | b1518 |
| CDS | + | 1605370 | 1606128 | tam | b1519 |
| CDS | − | 1606132 | 1607046 | yneE | b1520 |
| CDS | − | 1607253 | 1608704 | uxaB | b1521 |
| CDS | − | 1608931 | 1609878 | yneF | b1522 |
| CDS | − | 1609990 | 1610349 | yneG | b1523 |
| CDS | − | 1610349 | 1611275 | yneH | b1524 |
| CDS | − | 1611339 | 1612727 | yneI | b1525 |
| CDS | + | 1612828 | 1613709 | yneJ | b1526 |
| CDS | + | 1613787 | 1614902 | yneK | b1527 |
| CDS | + | 1615052 | 1616242 | sotB | b1528 |
| CDS | − | 1616267 | 1616932 | marC | b1529 |
| CDS | + | 1617144 | 1617578 | marR | b1530 |
| CDS | + | 1617598 | 1617981 | marA | b1531 |
| CDS | + | 1618013 | 1618231 | marB | b1532 |
| CDS | − | 1618262 | 1619161 | eamA | b1533 |
| CDS | + | 1619356 | 1620543 | ydeE | b1534 |
| CDS | − | 1620984 | 1621874 | ydeH | b1535 |
| CDS | − | 1622129 | 1622521 | ydeI | b1536 |
| CDS | + | 1622797 | 1623315 | ydeJ | b1537 |
| CDS | − | 1623359 | 1625404 | dcp | b1538 |
| CDS | + | 1625541 | 1626287 | ydfG | b1539 |
| CDS | + | 1626376 | 1627062 | ydfH | b1540 |
| CDS | + | 1627239 | 1627442 | ydfZ | b1541 |
| CDS | − | 1627477 | 1628937 | ydfI | b1542 |
| CDS | − | 1629026 | 1630309 | ydfJ | b1543 |
| CDS | + | 1631063 | 1631329 | ydfK | b1544 |
| CDS | + | 1631646 | 1632236 | pinQ | b1545 |
| CDS | − | 1632334 | 1632909 | tfaQ | b1546 |
| CDS | − | 1632909 | 1633871 | stfQ | b1547 |
| CDS | − | 1633822 | 1634391 | nohA | b1548 |
| CDS | + | 1635071 | 1635481 | ydfO | b1549 |
| CDS | − | 1635633 | 1635806 | gnsB | b1550 |
| CDS | − | 1635978 | 1636133 | ynfN | b1551 |
| CDS | − | 1636479 | 1636691 | cspI | b1552 |
| CDS | − | 1637054 | 1637551 | ydfP | b1553 |
| CDS | + | 1637548 | 1638081 | ydfQ | b1554 |
| CDS | − | 1638078 | 1638389 | ydfR | b1555 |
| CDS | − | 1638394 | 1638609 | essQ | b1556 |
| CDS | − | 1639363 | 1639578 | cspB | b1557 |
| CDS | + | 1639879 | 1640091 | cspF | b1558 |
| CDS | − | 1640513 | 1641265 | ydfT | b1559 |
| CDS | − | 1641271 | 1642328 | ydfU | b1560 |
| CDS | − | 1642675 | 1642926 | rem | b1561 |
| CDS | − | 1643143 | 1643298 | hokD | b1562 |
| CDS | − | 1643370 | 1643657 | relE | b1563 |
| CDS | − | 1643657 | 1643896 | relB | b1564 |
| CDS | + | 1643921 | 1644226 | ydfV | b1565 |
| CDS | + | 1644429 | 1644761 | flxA | b1566 |
| CDS | − | 1645198 | 1645347 | ydfW | b1567 |
| CDS | − | 1645370 | 1645660 | ydfX | b1568 |
| CDS | − | 1645644 | 1645874 | dicC | b1569 |
| CDS | + | 1645958 | 1646365 | dicA | b1570 |
| CDS | + | 1646532 | 1646687 | ydfA | b1571 |
| CDS | + | 1646689 | 1646817 | ydfB | b1572 |
| CDS | + | 1646847 | 1647065 | ydfC | b1573 |
| misc_RNA | + | 1647406 | 1647458 | dicF | b1574 |
| CDS | + | 1647633 | 1647821 | dicB | b1575 |
| CDS | + | 1647818 | 1648009 | ydfD | b1576 |
| CDS | + | 1648102 | 1649022 | ydfE | b1577 |
| repeat_region | − | 1648867 | 1649572 |  |  |
| CDS | + | 1648905 | 1649561 |  | b1578 |
| CDS | + | 1649536 | 1650732 | intQ | b1579 |
| CDS | − | 1650924 | 1651939 | rspB | b1580 |
| CDS | − | 1651951 | 1653165 | rspA | b1581 |
| CDS | − | 1653371 | 1653697 | ynfA | b1582 |
| CDS | + | 1653832 | 1654173 | ynfB | b1583 |
| CDS | + | 1654208 | 1654768 | speG | b1584 |
| CDS | − | 1654771 | 1655481 | ynfC | b1585 |
| CDS | + | 1655589 | 1655894 | ynfD | b1586 |
| CDS | + | 1656093 | 1658519 | ynfE | b1587 |
| CDS | + | 1658580 | 1661003 | ynfF | b1588 |
| CDS | + | 1661014 | 1661631 | ynfG | b1589 |
| CDS | + | 1661633 | 1662487 | ynfH | b1590 |
| CDS | + | 1662530 | 1663144 | ynfI | b1591 |
| CDS | + | 1663339 | 1664595 | ynfJ | b1592 |
| CDS | + | 1664548 | 1665243 | ynfK | b1593 |
| CDS | − | 1665368 | 1666588 | mlc | b1594 |
| CDS | − | 1666723 | 1667616 | ynfL | b1595 |
| CDS | + | 1667723 | 1668976 | ynfM | b1596 |
| CDS | + | 1669400 | 1669708 | asr | b1597 |
| CDS | + | 1669984 | 1670805 | ydgD | b1598 |
| CDS | − | 1670844 | 1671173 | ydgE | b1599 |
| CDS | − | 1671160 | 1671525 | ydgF | b1600 |
| CDS | + | 1671937 | 1672971 | ydgG | b1601 |
| CDS | − | 1672996 | 1674384 | pntB | b1602 |
| CDS | − | 1674395 | 1675927 | pntA | b1603 |
| CDS | + | 1676451 | 1677395 | ydgH | b1604 |
| CDS | + | 1677581 | 1678963 | ydgI | b1605 |
| CDS | + | 1679000 | 1679722 | ydgB | b1606 |
| CDS | − | 1679719 | 1680054 | ydgC | b1607 |
| CDS | + | 1680174 | 1680902 | rstA | b1608 |
| CDS | + | 1680906 | 1682207 | rstB | b1609 |
| CDS | + | 1682283 | 1683212 | tus | b1610 |
| CDS | − | 1683209 | 1684612 | fumC | b1611 |
| CDS | − | 1684755 | 1686401 | fumA | b1612 |
| CDS | + | 1686600 | 1687775 | manA | b1613 |
| CDS | + | 1687876 | 1689384 | ydgA | b1614 |

TABLE 1-continued

| Type | S | Left | Right | Name | B |
|---|---|---|---|---|---|
| CDS | − | 1689610 | 1690875 | uidC | b1615 |
| CDS | − | 1690914 | 1692287 | uidB | b1616 |
| CDS | − | 1692284 | 1694095 | uidA | b1617 |
| CDS | − | 1694486 | 1695076 | uidR | b1618 |
| CDS | − | 1695297 | 1696064 | hdhA | b1619 |
| CDS | − | 1696176 | 1697204 | malI | b1620 |
| CDS | + | 1697379 | 1698971 | malX | b1621 |
| CDS | + | 1698981 | 1700153 | malY | b1622 |
| CDS | + | 1700257 | 1701258 | add | b1623 |
| CDS | − | 1701292 | 1702332 | ydgJ | b1624 |
| CDS | + | 1702973 | 1703188 | ydgT | b1625 |
| CDS | + | 1703274 | 1703714 | ydgK | b1626 |
| CDS | + | 1703791 | 1704372 | rnfA | b1627 |
| CDS | + | 1704372 | 1704950 | rnfB | b1628 |
| CDS | + | 1704943 | 1707165 | rnfC | b1629 |
| CDS | + | 1707166 | 1708224 | rnfD | b1630 |
| CDS | + | 1708228 | 1708848 | rnfG | b1631 |
| CDS | + | 1708852 | 1709547 | rnfE | b1632 |
| CDS | + | 1709547 | 1710182 | nth | b1633 |
| CDS | + | 1710793 | 1712295 | ydgR | b1634 |
| CDS | + | 1712401 | 1713006 | gst | b1635 |
| CDS | − | 1713050 | 1713913 | pdxY | b1636 |
| CDS | − | 1713972 | 1715246 | tyrS | b1637 |
| CDS | − | 1715375 | 1716031 | pdxH | b1638 |
| CDS | − | 1716090 | 1716419 | ydhA | b1639 |
| CDS | − | 1716517 | 1717626 | ydhH | b1640 |
| CDS | + | 1717900 | 1718367 | slyB | b1641 |
| CDS | − | 1718414 | 1718848 | slyA | b1642 |
| CDS | + | 1719049 | 1719285 | ydhI | b1643 |
| CDS | + | 1719288 | 1720145 | ydhJ | b1644 |
| CDS | + | 1720145 | 1722157 | ydhK | b1645 |
| CDS | − | 1722158 | 1722679 | sodC | b1646 |
| CDS | − | 1722760 | 1723656 | ydhF | b1647 |
| CDS | − | 1723705 | 1723944 | ydhL | b1648 |
| CDS | + | 1724131 | 1724646 | ydhM | b1649 |
| CDS | + | 1724683 | 1725780 | nemA | b1650 |
| CDS | + | 1725861 | 1726268 | gloA | b1651 |
| CDS | + | 1726371 | 1727018 | rnt | b1652 |
| CDS | + | 1727111 | 1731727 | lhr | b1653 |
| CDS | − | 1731778 | 1732125 | ydhD | b1654 |
| CDS | + | 1732459 | 1733274 | ydhO | b1655 |
| CDS | + | 1733402 | 1733983 | sodB | b1656 |
| CDS | − | 1734145 | 1735314 | ydhP | b1657 |
| CDS | + | 1735868 | 1736893 | purR | b1658 |
| CDS | − | 1736890 | 1737822 | ydhB | b1659 |
| CDS | + | 1737935 | 1739146 | ydhC | b1660 |
| CDS | + | 1739437 | 1740585 | cfa | b1661 |
| CDS | − | 1740625 | 1741266 | ribC | b1662 |
| CDS | + | 1741481 | 1742854 | norM | b1663 |
| CDS | − | 1742895 | 1744151 | ydhQ | b1664 |
| tRNA | + | 1744459 | 1744535 | valV | b1665 |
| tRNA | + | 1744540 | 1744616 | valW | b1666 |
| CDS | + | 1744724 | 1745029 | ydhR | b1667 |
| CDS | + | 1745155 | 1746759 | ydhS | b1668 |
| CDS | − | 1746771 | 1747583 | ydhT | b1669 |
| CDS | − | 1747587 | 1748372 | ydhU | b1670 |
| CDS | − | 1748369 | 1749037 | ydhX | b1671 |
| CDS | − | 1749101 | 1749748 | ydhW | b1672 |
| CDS | − | 1749752 | 1751854 | ydhV | b1673 |
| CDS | − | 1751875 | 1752501 | ydhY | b1674 |
| CDS | − | 1752956 | 1753165 | ydhZ | b1675 |
| CDS | + | 1753722 | 1755134 | pykF | b1676 |
| CDS | + | 1755445 | 1755681 | lpp | b1677 |
| CDS | − | 1755745 | 1756749 | ynhG | b1678 |
| CDS | − | 1756898 | 1757314 | sufE | b1679 |
| CDS | − | 1757327 | 1758547 | sufS | b1680 |
| CDS | − | 1758544 | 1759815 | sufD | b1681 |
| CDS | − | 1759790 | 1760536 | sufC | b1682 |
| CDS | − | 1760546 | 1762033 | sufB | b1683 |
| CDS | − | 1762042 | 1762410 | sufA | b1684 |
| CDS | − | 1762958 | 1763227 | ydiH | b1685 |
| CDS | − | 1763246 | 1763656 | ydiI | b1686 |
| CDS | − | 1763653 | 1766709 | ydiJ | b1687 |
| CDS | + | 1767098 | 1768210 | ydiK | b1688 |
| CDS | + | 1768639 | 1768995 | ydiL | b1689 |
| CDS | + | 1769095 | 1770309 | ydiM | b1690 |
| CDS | + | 1770536 | 1771801 | ydiN | b1691 |
| CDS | + | 1771813 | 1772679 | ydiB | b1692 |
| CDS | + | 1772710 | 1773468 | aroD | b1693 |
| CDS | + | 1773611 | 1775206 | ydiP | b1694 |
| CDS | + | 1775220 | 1776371 | ydiO | b1695 |
| CDS | − | 1776414 | 1777325 | ydiP | b1696 |
| CDS | + | 1777641 | 1778405 | ydiQ | b1697 |
| CDS | + | 1778425 | 1779363 | ydiR | b1698 |
| CDS | + | 1779419 | 1780708 | ydiS | b1699 |
| CDS | + | 1780705 | 1780998 | ydiT | b1700 |
| CDS | + | 1781001 | 1782701 | ydiD | b1701 |
| CDS | − | 1782758 | 1785136 | ppsA | b1702 |
| CDS | + | 1785469 | 1786302 | ydiA | b1703 |
| CDS | + | 1786459 | 1787505 | aroH | b1704 |
| CDS | + | 1787637 | 1787828 | ydiE | b1705 |
| CDS | − | 1787832 | 1789268 | ydiU | b1706 |
| CDS | − | 1789331 | 1790044 | ydiV | b1707 |
| CDS | − | 1790291 | 1790755 | nlpC | b1708 |
| CDS | − | 1790833 | 1791582 | btuD | b1709 |
| CDS | − | 1791582 | 1792133 | btuE | b1710 |
| CDS | − | 1792196 | 1793176 | btuC | b1711 |
| CDS | − | 1793277 | 1793576 | himA | b1712 |
| CDS | − | 1793581 | 1795968 | pheT | b1713 |
| CDS | − | 1795983 | 1796966 | pheS | b1714 |
| CDS | − | 1797202 | 1797294 | pheM | b1715 |
| CDS | − | 1797417 | 1797773 | rplT | b1716 |
| CDS | − | 1797826 | 1798023 | rpmI | b1717 |
| CDS | − | 1798120 | 1798662 | infC | b1718 |
| CDS | − | 1798666 | 1800594 | thrS | b1719 |
| CDS | + | 1801118 | 1801591 | arpB_1 | b1720 |
| CDS | + | 1801602 | 1803017 | arpB_2 | b1721 |
| CDS | − | 1803349 | 1804107 | ydiY | b1722 |
| CDS | + | 1804394 | 1805323 | pfkB | b1723 |
| CDS | + | 1805424 | 1805714 | ydiZ | b1724 |
| CDS | + | 1805820 | 1806680 | yniA | b1725 |
| CDS | − | 1806721 | 1807257 | yniB | b1726 |
| CDS | + | 1807404 | 1808072 | yniC | b1727 |
| CDS | + | 1808235 | 1808825 | ydjM | b1728 |
| CDS | + | 1808958 | 1810349 | ydjN | b1729 |
| CDS | − | 1810353 | 1811168 | ydjO | b1730 |
| CDS | − | 1811445 | 1811708 | cedA | b1731 |
| CDS | + | 1811891 | 1814152 | katE | b1732 |
| CDS | + | 1814410 | 1815159 | ydjC | b1733 |
| CDS | − | 1815172 | 1816524 | celF | b1734 |
| CDS | − | 1816629 | 1817471 | celD | b1735 |
| CDS | − | 1817479 | 1817829 | celC | b1736 |
| CDS | − | 1817880 | 1819238 | celB | b1737 |
| CDS | − | 1819323 | 1819643 | celA | b1738 |
| CDS | − | 1819942 | 1820280 | osmE | b1739 |
| CDS | + | 1820482 | 1821309 | nadE | b1740 |
| CDS | + | 1821539 | 1822426 | ydjQ | b1741 |
| CDS | + | 1822386 | 1822961 | ydjR | b1742 |
| CDS | + | 1823164 | 1823649 | spy | b1743 |
| CDS | − | 1823699 | 1824947 | astE | b1744 |
| CDS | − | 1824940 | 1826283 | astB | b1745 |
| CDS | − | 1826280 | 1827758 | astD | b1746 |
| CDS | − | 1827755 | 1828789 | astA | b1747 |
| CDS | − | 1828786 | 1830006 | astC | b1748 |
| CDS | + | 1830452 | 1831258 | xthA | b1749 |
| CDS | + | 1831425 | 1832135 | ydjX | b1750 |
| CDS | + | 1832140 | 1832817 | ydjY | b1751 |
| CDS | + | 1832832 | 1833539 | ydjZ | b1752 |
| CDS | + | 1833539 | 1834087 | ynjA | b1753 |
| CDS | + | 1834097 | 1835263 | ynjB | b1754 |
| CDS | + | 1835281 | 1836771 | ynjC | b1755 |
| CDS | + | 1836771 | 1837424 | ynjD | b1756 |
| CDS | + | 1837491 | 1838798 | ynjE | b1757 |
| CDS | − | 1838807 | 1839427 | ynjF | b1758 |
| CDS | + | 1839514 | 1839921 | nudG | b1759 |
| CDS | − | 1839887 | 1840159 | ynjH | b1760 |
| CDS | + | 1840395 | 1841738 | gdhA | b1761 |
| CDS | − | 1841855 | 1842895 | ynjI | b1762 |
| CDS | + | 1843023 | 1844984 | topB | b1763 |
| CDS | + | 1844989 | 1846032 | selD | b1764 |
| CDS | − | 1846149 | 1846700 | ydjA | b1765 |
| CDS | + | 1846861 | 1848717 | sppA | b1766 |
| CDS | + | 1848884 | 1849900 | ansA | b1767 |
| CDS | + | 1849911 | 1850552 | pncA | b1768 |
| CDS | − | 1850645 | 1852003 | ydjE | b1769 |
| CDS | − | 1852120 | 1852878 | ydjF | b1770 |

TABLE 1-continued

| Type | S | Left | Right | Name | B |
|---|---|---|---|---|---|
| CDS | − | 1853015 | 1853995 | ydjG | b1771 |
| CDS | − | 1854005 | 1854952 | ydjH | b1772 |
| CDS | − | 1854957 | 1855793 | ydjI | b1773 |
| CDS | − | 1855814 | 1856857 | ydjJ | b1774 |
| CDS | − | 1856874 | 1858253 | ydjK | b1775 |
| CDS | − | 1858280 | 1859356 | ydjL | b1776 |
| CDS | − | 1859726 | 1859998 | yeaC | b1777 |
| CDS | − | 1860040 | 1860453 | yeaA | b1778 |
| CDS | + | 1860795 | 1861790 | gapA | b1779 |
| CDS | + | 1861874 | 1862758 | yeaD | b1780 |
| CDS | − | 1862806 | 1863660 | yeaE | b1781 |
| CDS | − | 1863750 | 1864496 | mipA | b1782 |
| CDS | + | 1864932 | 1866866 | yeaG | b1783 |
| CDS | + | 1866979 | 1868262 | yeaH | b1784 |
| CDS | + | 1868409 | 1869884 | yeaI | b1785 |
| CDS | + | 1870065 | 1871555 | yeaJ | b1786 |
| CDS | + | 1871598 | 1872101 | yeaK | b1787 |
| CDS | − | 1872102 | 1872206 |  | b1788 |
| CDS | + | 1872376 | 1872822 | yeaL | b1789 |
| CDS | − | 1872779 | 1873600 | yeaM | b1790 |
| CDS | + | 1873697 | 1874878 | yeaN | b1791 |
| CDS | + | 1874933 | 1875280 | yeaO | b1792 |
| CDS | − | 1875302 | 1875556 | yoaF | b1793 |
| CDS | + | 1875739 | 1876764 | yeaP | b1794 |
| CDS | − | 1877031 | 1877279 | yeaQ | b1795 |
| CDS | − | 1877427 | 1877609 | yoaG | b1796 |
| CDS | − | 1877613 | 1877972 | yeaR | b1797 |
| CDS | − | 1878145 | 1878783 | yeaS | b1798 |
| CDS | − | 1878910 | 1879833 | yeaT | b1799 |
| CDS | + | 1879936 | 1881021 | yeaU | b1800 |
| CDS | + | 1881212 | 1882657 | yeaV | b1801 |
| CDS | + | 1882689 | 1883813 | yeaW | b1802 |
| CDS | + | 1883869 | 1884834 | yeaX | b1803 |
| CDS | − | 1884888 | 1886015 | rnd | b1804 |
| CDS | − | 1886085 | 1887770 | fadD | b1805 |
| CDS | − | 1887975 | 1888556 | yeaY | b1806 |
| CDS | − | 1888596 | 1889291 | yeaZ | b1807 |
| CDS | − | 1889349 | 1891259 | yoaA | b1808 |
| CDS | + | 1891391 | 1891735 | yoaB | b1809 |
| CDS | + | 1892097 | 1892456 | yoaC | b1810 |
| CDS | − | 1892576 | 1892755 | yoaH | b1811 |
| CDS | + | 1892829 | 1894190 | pabB | b1812 |
| CDS | + | 1894194 | 1894772 | yeaB | b1813 |
| CDS | + | 1894956 | 1896320 | sdaA | b1814 |
| CDS | + | 1896451 | 1898049 | yoaD | b1815 |
| CDS | − | 1898053 | 1899609 | yoaE | b1816 |
| CDS | + | 1900072 | 1901043 | manX | b1817 |
| CDS | + | 1901106 | 1901906 | manY | b1818 |
| CDS | + | 1901910 | 1902770 | manZ | b1819 |
| CDS | + | 1902825 | 1903283 | yobD | b1820 |
| CDS | + | 1903712 | 1904278 | yebN | b1821 |
| CDS | − | 1904275 | 1905084 | rrmA | b1822 |
| CDS | − | 1905250 | 1905459 | cspC | b1823 |
| CDS | − | 1905472 | 1905615 | yobF | b1824 |
| CDS | − | 1906285 | 1906572 | yebO | b1825 |
| CDS | − | 1906647 | 1906790 | yobG | b1826 |
| CDS | − | 1907332 | 1908123 | kdgR | b1827 |
| CDS | + | 1908300 | 1909673 | yebQ | b1828 |
| CDS | − | 1909719 | 1910600 | htpX | b1829 |
| CDS | − | 1910792 | 1912840 | prc | b1830 |
| CDS | − | 1912860 | 1913558 | proQ | b1831 |
| CDS | − | 1913655 | 1914206 | yebR | b1832 |
| CDS | + | 1914282 | 1915565 | yebS | b1833 |
| CDS | + | 1915534 | 1918167 | yebT | b1834 |
| CDS | + | 1918247 | 1919686 | yebU | b1835 |
| CDS | + | 1919804 | 1920040 | yebV | b1836 |
| CDS | + | 1920145 | 1920336 | yebW | b1837 |
| CDS | − | 1920337 | 1920993 | pphA | b1838 |
| CDS | − | 1921389 | 1921730 | yebY | b1839 |
| CDS | − | 1921743 | 1922615 | yebZ | b1840 |
| CDS | − | 1922619 | 1922993 | yobA | b1841 |
| CDS | + | 1923132 | 1923362 | holE | b1842 |
| CDS | + | 1923464 | 1924120 | yobB | b1843 |
| CDS | + | 1924144 | 1924806 | exoX | b1844 |
| CDS | − | 1924803 | 1926863 | ptrB | b1845 |
| CDS | − | 1927072 | 1927731 | yebE | b1846 |
| CDS | − | 1928058 | 1928426 | yebF | b1847 |
| CDS | − | 1928481 | 1928771 | yebG | b1848 |
| CDS | + | 1928905 | 1930083 | purT | b1849 |
| CDS | − | 1930139 | 1930780 | eda | b1850 |
| CDS | − | 1930817 | 1932628 | edd | b1851 |
| CDS | − | 1932863 | 1934338 | zwf | b1852 |
| CDS | + | 1934676 | 1935545 | yebK | b1853 |
| CDS | + | 1935673 | 1937115 | pykA | b1854 |
| CDS | − | 1937246 | 1938217 | msbB | b1855 |
| CDS | − | 1938337 | 1939659 | yebA | b1856 |
| CDS | − | 1939675 | 1940607 | znuA | b1857 |
| CDS | + | 1940686 | 1941441 | znuC | b1858 |
| CDS | + | 1941438 | 1942223 | znuB | b1859 |
| CDS | − | 1942370 | 1943380 | ruvB | b1860 |
| CDS | − | 1943389 | 1944000 | ruvA | b1861 |
| CDS | + | 1944275 | 1944877 | yebB | b1862 |
| CDS | − | 1944879 | 1945400 | ruvC | b1863 |
| CDS | − | 1945435 | 1946175 | yebC | b1864 |
| CDS | − | 1946204 | 1946656 | ntpA | b1865 |
| CDS | − | 1946774 | 1948546 | aspS | b1866 |
| CDS | + | 1948856 | 1949422 | yecD | b1867 |
| CDS | + | 1949419 | 1950237 | yecE | b1868 |
| CDS | + | 1950290 | 1950685 | yecN | b1869 |
| CDS | + | 1950726 | 1951469 | yecO | b1870 |
| CDS | + | 1951466 | 1952437 | yecP | b1871 |
| CDS | − | 1952602 | 1955031 | torZ | b1872 |
| CDS | − | 1955056 | 1956156 | torY | b1873 |
| CDS | − | 1956544 | 1957290 | cutC | b1874 |
| CDS | − | 1957304 | 1957870 | yecM | b1875 |
| CDS | + | 1958086 | 1959819 | argS | b1876 |
| CDS | + | 1959996 | 1960484 | yecT | b1877 |
| CDS | − | 1960604 | 1960996 | flhE | b1878 |
| CDS | − | 1960996 | 1963074 | flhA | b1879 |
| CDS | − | 1963067 | 1964215 | flhB | b1880 |
| CDS | − | 1964417 | 1965061 | cheZ | b1881 |
| CDS | − | 1965072 | 1965461 | cheY | b1882 |
| CDS | − | 1965476 | 1966525 | cheB | b1883 |
| CDS | − | 1966528 | 1967388 | cheR | b1884 |
| CDS | − | 1967407 | 1969008 | tap | b1885 |
| CDS | − | 1969054 | 1970715 | tar | b1886 |
| CDS | − | 1970860 | 1971363 | cheW | b1887 |
| CDS | − | 1971384 | 1973348 | cheA | b1888 |
| CDS | − | 1973353 | 1974279 | motB | b1889 |
| CDS | − | 1974276 | 1975163 | motA | b1890 |
| CDS | − | 1975290 | 1975868 | flhC | b1891 |
| CDS | − | 1975871 | 1976230 | flhD | b1892 |
| repeat_region |  | 1976527 | 1977294 |  |  |
| CDS | − | 1976542 | 1977045 | insB_5 | b1893 |
| CDS | − | 1976964 | 1977239 | insA_5 | b1894 |
| CDS | + | 1977777 | 1978205 | yecG | b1895 |
| CDS | + | 1978212 | 1979636 | otsA | b1896 |
| CDS | − | 1979611 | 1980411 | otsB | b1897 |
| CDS | − | 1981579 | 1983093 | araG | b1900 |
| CDS | − | 1983163 | 1984152 | araF | b1901 |
| CDS | + | 1984949 | 1985452 | yecI | b1902 |
| CDS | + | 1985468 | 1985806 |  | b1903 |
| CDS | + | 1986246 | 1986569 | yecR | b1904 |
| CDS | + | 1986740 | 1987237 | ftn | b1905 |
| CDS | − | 1987275 | 1987514 | yecH | b1906 |
| CDS | + | 1987705 | 1988916 | tyrP | b1907 |
| CDS | − | 1988978 | 1989643 | yecA | b1908 |
| tRNA | − | 1989839 | 1989925 | leuZ | b1909 |
| tRNA | − | 1989938 | 1990011 | cysT | b1910 |
| tRNA | − | 1990066 | 1990141 | glyW | b1911 |
| CDS | − | 1990293 | 1990841 | pgsA | b1912 |
| CDS | − | 1990898 | 1992730 | uvrC | b1913 |
| CDS | − | 1992727 | 1993383 | uvrY | b1914 |
| CDS | + | 1993842 | 1994066 | yecF | b1915 |
| CDS | + | 1994134 | 1994856 | sdiA | b1916 |
| CDS | − | 1995086 | 1995838 | yecC | b1917 |
| CDS | − | 1995835 | 1996503 | yecS | b1918 |
| CDS | − | 1996518 | 1997504 | yedO | b1919 |
| CDS | − | 1997609 | 1998409 | fliY | b1920 |
| CDS | − | 1998497 | 1999048 | fliZ | b1921 |
| CDS | − | 1999094 | 1999813 | fliA | b1922 |
| CDS | − | 2000134 | 2001630 | fliC | b1923 |
| CDS | + | 2001896 | 2003302 | fliD | b1924 |
| CDS | + | 2003327 | 2003737 | fliS | b1925 |
| CDS | + | 2003737 | 2004102 | fliT | b1926 |
| CDS | + | 2004180 | 2005667 | amyA | b1927 |

TABLE 1-continued

| Type | S | Left | Right | Name | B |
|---|---|---|---|---|---|
| CDS | − | 2005701 | 2006114 | yedD | b1928 |
| CDS | + | 2006301 | 2007506 | yedE | b1929 |
| CDS | + | 2007503 | 2007736 | yedF | b1930 |
| CDS | + | 2007845 | 2008513 | yedK | b1931 |
| CDS | + | 2008624 | 2009103 | yedL | b1932 |
| CDS | − | 2009372 | 2009563 | yedN_2 | b1933 |
| CDS | − | 2009573 | 2009893 | yedN_1 | b1934 |
| CDS | − | 2010025 | 2010375 | yedM | b1935 |
| CDS | + | 2010526 | 2010804 |  | b1936 |
| CDS | − | 2010724 | 2011038 | fliE | b1937 |
| CDS | + | 2011253 | 2012911 | fliF | b1938 |
| CDS | + | 2012904 | 2013899 | fliG | b1939 |
| CDS | + | 2013892 | 2014578 | fliH | b1940 |
| CDS | + | 2014578 | 2015951 | fliI | b1941 |
| CDS | + | 2015970 | 2016413 | fliJ | b1942 |
| CDS | + | 2016410 | 2017537 | fliK | b1943 |
| CDS | + | 2017642 | 2018106 | fliL | b1944 |
| CDS | + | 2018111 | 2019115 | fliM | b1945 |
| CDS | + | 2019112 | 2019525 | fliN | b1946 |
| CDS | + | 2019528 | 2019893 | fliO | b1947 |
| CDS | + | 2019893 | 2020630 | fliP | b1948 |
| CDS | + | 2020640 | 2020909 | fliQ | b1949 |
| CDS | + | 2020917 | 2021702 | fliR | b1950 |
| CDS | + | 2021992 | 2022615 | rcsA | b1951 |
| CDS | − | 2022659 | 2022847 | dsrB | b1952 |
| CDS | + | 2023010 | 2023237 | yodD | b1953 |
| misc_RNA | − | 2023251 | 2023337 | dsrA | b1954 |
| CDS | + | 2023535 | 2024350 | yedP | b1955 |
| CDS | − | 2024347 | 2026041 | yedQ | b1956 |
| CDS | − | 2026212 | 2026394 | yodC | b1957 |
| CDS | − | 2026473 | 2027390 | yedI | b1958 |
| CDS | + | 2027563 | 2028483 | yedA | b1959 |
| CDS | − | 2028472 | 2028942 | vsr | b1960 |
| CDS | − | 2028923 | 2030341 | dcm | b1961 |
| CDS | − | 2030408 | 2031103 | yedJ | b1962 |
| CDS | − | 2031143 | 2031508 | yedR | b1963 |
| CDS | + | 2032075 | 2032560 | yedS_1 | b1964 |
| CDS | + | 2032570 | 2032779 | yedS_2 | b1965 |
| CDS | + | 2032863 | 2033267 | yedS_3 | b1966 |
| CDS | + | 2033859 | 2034710 | yedU | b1967 |
| CDS | − | 2034818 | 2036176 | yedV | b1968 |
| CDS | − | 2036176 | 2036847 | yedW | b1969 |
| CDS | + | 2036980 | 2037393 | yedX | b1970 |
| CDS | + | 2037502 | 2038506 | yedY | b1971 |
| CDS | + | 2038507 | 2039142 | yedZ | b1972 |
| CDS | + | 2039399 | 2040049 | yodA | b1973 |
| CDS | + | 2040392 | 2040922 | yodB | b1974 |
| tRNA | − | 2041492 | 2041581 | serU | b1975 |
| CDS | + | 2041675 | 2042472 | yeeI | b1976 |
| tRNA | + | 2042573 | 2042648 | asnT | b1977 |
| CDS | + | 2042935 | 2050038 | yeeJ | b1978 |
| CDS | − | 2050300 | 2050626 | yeeL_2 | b1979 |
| CDS | − | 2050648 | 2051352 | yeeL_1 | b1980 |
| CDS | + | 2051667 | 2052983 | shiA | b1981 |
| CDS | + | 2053085 | 2054539 | amn | b1982 |
| CDS | + | 2054882 | 2055598 | yeeN | b1983 |
| tRNA | − | 2056051 | 2056126 | asnW | b1984 |
| CDS | − | 2056227 | 2057870 | yeeO | b1985 |
| tRNA | + | 2057875 | 2057950 | asnU | b1986 |
| CDS | − | 2057988 | 2058938 | cbl | b1987 |
| CDS | − | 2059040 | 2059957 | nac | b1988 |
| tRNA | + | 2060284 | 2060359 | asnV | b1989 |
| CDS | − | 2060415 | 2061347 | erfK | b1990 |
| CDS | − | 2061412 | 2062491 | cobT | b1991 |
| CDS | − | 2062503 | 2063246 | cobS | b1992 |
| CDS | − | 2063243 | 2063788 | cobU | b1993 |
| repeat_region | + | 2064183 | 2065377 |  |  |
| CDS | − | 2064329 | 2065345 | trs5_6 | b1994 |
| CDS | − | 2066659 | 2067051 |  | b1995 |
| repeat_egion | + | 2066965 | 2068295 |  |  |
| CDS | − | 2066976 | 2067881 | yi22_3 | b1996 |
| CDS | − | 2067839 | 2068249 | yi21_3 | b1997 |
| CDS | + | 2068268 | 2068528 |  | b1998 |
| CDS | + | 2068810 | 2069235 | yeeP | b1999 |
| CDS | + | 2069563 | 2072682 | flu | b2000 |
| CDS | + | 2072803 | 2074335 | yeeR | b2001 |
| CDS | + | 2074332 | 2074778 | yeeS | b2002 |
| CDS | + | 2074841 | 2075062 | yeeT | b2003 |
| CDS | + | 2075136 | 2075504 | yeeU | b2004 |
| CDS | + | 2075593 | 2075967 | yeeV | b2005 |
| CDS | + | 2075964 | 2076158 | yeeW | b2006 |
| CDS | − | 2077056 | 2077451 | yeeX | b2007 |
| CDS | − | 2077557 | 2078615 | yeeA | b2008 |
| CDS | − | 2078813 | 2079286 | sbmC | b2009 |
| CDS | − | 2079405 | 2080571 | dacD | b2010 |
| CDS | + | 2080780 | 2082207 | sbcB | b2011 |
| CDS | − | 2082250 | 2082477 | yeeD | b2012 |
| CDS | − | 2082491 | 2083549 | yeeE | b2013 |
| CDS | − | 2083728 | 2085086 | yeeF | b2014 |
| CDS | − | 2085353 | 2086282 | yeeY | b2015 |
| CDS | − | 2086328 | 2087152 | yeeZ | b2016 |
| CDS | − | 2087486 | 2087737 | yefM | b2017 |
| CDS | + | 2088020 | 2088070 | hisL | b2018 |
| CDS | + | 2088216 | 2089115 | hisG | b2019 |
| CDS | + | 2089121 | 2090425 | hisD | b2020 |
| CDS | + | 2090422 | 2091492 | hisC | b2021 |
| CDS | + | 2091492 | 2092559 | hisB | b2022 |
| CDS | + | 2092559 | 2093149 | hisH | b2023 |
| CDS | + | 2093149 | 2093886 | hisA | b2024 |
| CDS | + | 2093868 | 2094644 | hisF | b2025 |
| CDS | + | 2094638 | 2096549 | hisI | b2026 |
| CDS | − | 2095345 | 2096325 | cld | b2027 |
| CDS | − | 2096471 | 2097637 | ugd | b2028 |
| CDS | − | 2097886 | 2099292 | gnd | b2029 |
| repeat_region | + | 2099773 | 2100967 |  |  |
| CDS | − | 2099919 | 2100935 | trs5_7 | b2030 |
| CDS | − | 2099420 | 2101413 | wbbL | b2031 |
| CDS | − | 2101415 | 2102533 | wbbK | b2032 |
| CDS | − | 2102518 | 2103108 | wbbJ | b2033 |
| CDS | − | 2103089 | 2104081 | wbbI | b2034 |
| CDS | − | 2104084 | 2105250 | rfc | b2035 |
| CDS | − | 2105250 | 2106353 | glf | b2036 |
| CDS | − | 2106361 | 2107608 | rfbX | b2037 |
| CDS | − | 2107605 | 2108162 | rfbC | b2038 |
| CDS | − | 2108162 | 2109043 | rfbA | b2039 |
| CDS | − | 2109101 | 2110000 | rfbD | b2040 |
| CDS | − | 2110000 | 2111085 | rfbB | b2041 |
| CDS | − | 2111458 | 2112351 | galF | b2042 |
| CDS | − | 2112526 | 2113920 | wcaM | b2043 |
| CDS | − | 2113931 | 2115151 | wcaL | b2044 |
| CDS | − | 2115148 | 2116428 | wcaK | b2045 |
| CDS | − | 2116704 | 2118182 | wzxC | b2046 |
| CDS | − | 2118184 | 2119578 | wcaJ | b2047 |
| CDS | − | 2119633 | 2121003 | cpsG | b2048 |
| CDS | − | 2121108 | 2122544 | cpsB | b2049 |
| CDS | − | 2122547 | 2123770 | wcaI | b2050 |
| CDS | − | 2123767 | 2124246 | wcaH | b2051 |
| CDS | − | 2124249 | 2125214 | wcaG | b2052 |
| CDS | − | 2125217 | 2126338 | gmd | b2053 |
| CDS | − | 2126364 | 2126912 | wcaF | b2054 |
| CDS | − | 2126928 | 2127674 | wcaE | b2055 |
| CDS | − | 2127685 | 2128902 | wcaD | b2056 |
| CDS | − | 2128877 | 2130094 | wcaC | b2057 |
| CDS | − | 2130091 | 2130579 | wcaB | b2058 |
| CDS | − | 2130582 | 2131421 | wcaA | b2059 |
| CDS | − | 2131514 | 2133676 | wzc | b2060 |
| CDS | − | 2133679 | 2134122 | wzb | b2061 |
| CDS | − | 2134128 | 2135267 | wza | b2062 |
| CDS | + | 2135926 | 2137509 | yegH | b2063 |
| CDS | − | 2137783 | 2139636 | asmA | b2064 |
| CDS | − | 2139658 | 2140239 | dcd | b2065 |
| CDS | − | 2140331 | 2140972 | udk | b2066 |
| CDS | + | 2141290 | 2144607 | yegE | b2067 |
| CDS | + | 2144716 | 2145564 | alkA | b2068 |
| CDS | + | 2145698 | 2147050 | yegD | b2069 |
| CDS | − | 2147063 | 2149009 | yegI | b2070 |
| CDS | + | 2149209 | 2149670 | yegJ | b2071 |
| CDS | − | 2149735 | 2150496 | yegK | b2072 |
| CDS | − | 2150493 | 2151152 | yegL | b2073 |
| CDS | + | 2152040 | 2153287 | yegM | b2074 |
| CDS | + | 2153287 | 2156409 | yegN | b2075 |
| CDS | + | 2156410 | 2159487 | yegO | b2076 |
| CDS | + | 2159488 | 2160903 | yegB | b2077 |
| CDS | + | 2160900 | 2162303 | baeS | b2078 |
| CDS | + | 2162300 | 2163022 | baeR | b2079 |
| CDS | + | 2163213 | 2163545 | yegP | b2080 |

TABLE 1-continued

| Type | S | Left | Right | Name | B |
|---|---|---|---|---|---|
| CDS | + | 2163692 | 2165053 | yegQ | b2081 |
| CDS | − | 2165326 | 2165544 | ogrK | b2082 |
| CDS | − | 2165626 | 2165844 | yegZ | b2083 |
| CDS | − | 2165759 | 2166025 | | b2084 |
| CDS | − | 2166013 | 2166330 | yegR | b2085 |
| CDS | − | 2166736 | 2167635 | yegS | b2086 |
| CDS | + | 2167717 | 2168163 | gatR_1 | b2087 |
| repeat_region | + | 2168195 | 2169452 | | |
| CDS | + | 2168251 | 2168559 | | b2088 |
| CDS | + | 2168556 | 2169422 | tra5_4 | b2089 |
| CDS | − | 2169419 | 2169757 | gatR_2 | b2090 |
| CDS | − | 2169857 | 2170897 | gatD | b2091 |
| CDS | − | 2170945 | 2172300 | gatC | b2092 |
| CDS | − | 2172304 | 2172588 | gatB | b2093 |
| CDS | − | 2172619 | 2173071 | gatA | b2094 |
| CDS | − | 2173081 | 2174343 | gatZ | b2095 |
| CDS | − | 2174372 | 2175226 | gatY | b2096 |
| CDS | − | 2175534 | 2176586 | fbaB | b2097 |
| CDS | + | 2176843 | 2178120 | yegT | b2098 |
| CDS | + | 2178117 | 2179121 | yegU | b2099 |
| CDS | + | 2179118 | 2180083 | yegV | b2100 |
| CDS | − | 2180057 | 2180803 | yegW | b2101 |
| CDS | − | 2180855 | 2181673 | yegX | b2102 |
| CDS | − | 2181738 | 2182538 | thiD | b2103 |
| CDS | − | 2182535 | 2183323 | thiM | b2104 |
| CDS | − | 2183546 | 2183818 | yohL | b2105 |
| CDS | + | 2183939 | 2184763 | yohM | b2106 |
| CDS | + | 2184982 | 2185320 | yohN | b2107 |
| CDS | − | 2185402 | 2186436 | yehA | b2108 |
| CDS | − | 2186452 | 2188932 | yehB | b2109 |
| CDS | − | 2188948 | 2189667 | yehC | b2110 |
| CDS | − | 2189702 | 2190244 | yehD | b2111 |
| CDS | − | 2190537 | 2190818 | yehE | b2112 |
| CDS | − | 2191081 | 2192190 | mrp | b2113 |
| CDS | + | 2192322 | 2194355 | metG | b2114 |
| CDS | + | 2194496 | 2195320 | molR_1 | b2115 |
| CDS | + | 2195432 | 2197369 | molR_2 | b2116 |
| CDS | + | 2197344 | 2198291 | molR_3 | b2117 |
| CDS | + | 2198301 | 2201933 | yehI | b2118 |
| CDS | + | 2202618 | 2203706 | yehL | b2119 |
| CDS | + | 2203717 | 2205996 | yehM | b2120 |
| CDS | + | 2205989 | 2207125 | yehP | b2121 |
| CDS | + | 2207122 | 2208966 | yehQ | b2122 |
| CDS | + | 2209247 | 2209708 | yehR | b2123 |
| CDS | − | 2209748 | 2210218 | yehS | b2124 |
| CDS | − | 2210265 | 2210984 | yehT | b2125 |
| CDS | − | 2210981 | 2212666 | yehU | b2126 |
| CDS | + | 2212888 | 2213619 | yehV | b2127 |
| CDS | − | 2213767 | 2214498 | yehW | b2128 |
| CDS | − | 2214503 | 2215429 | yehX | b2129 |
| CDS | − | 2215422 | 2216579 | yehY | b2130 |
| CDS | − | 2216586 | 2217503 | yehZ | b2131 |
| CDS | − | 2217714 | 2220011 | bglX | b2132 |
| CDS | + | 2220207 | 2221922 | dld | b2133 |
| CDS | − | 2221960 | 2222892 | pbpG | b2134 |
| CDS | − | 2223066 | 2223653 | yohC | b2135 |
| CDS | + | 2223823 | 2224401 | yohD | b2136 |
| CDS | − | 2224531 | 2225292 | yohF | b2137 |
| CDS | − | 2225345 | 2226433 | yohG | b2138 |
| CDS | − | 2226571 | 2226708 | yohH | b2139 |
| CDS | − | 2227460 | 2228407 | yohI | b2140 |
| CDS | + | 2228646 | 2229044 | yohJ | b2141 |
| CDS | + | 2229041 | 2229736 | yohK | b2142 |
| CDS | + | 2229866 | 2230750 | cdd | b2143 |
| CDS | + | 2230900 | 2231619 | sanA | b2144 |
| CDS | + | 2231622 | 2231861 | yeiS | b2145 |
| CDS | + | 2232055 | 2233293 | yeiT | b2146 |
| CDS | + | 2233287 | 2234522 | yeiA | b2147 |
| CDS | − | 2234765 | 2235775 | mglC | b2148 |
| CDS | − | 2235791 | 2237311 | mglA | b2149 |
| CDS | − | 2237372 | 2238370 | mglB | b2150 |
| CDS | − | 2238650 | 2239690 | galS | b2151 |
| CDS | − | 2239832 | 2240989 | yeiB | b2152 |
| CDS | − | 2241006 | 2241674 | folE | b2153 |
| CDS | + | 2241932 | 2242768 | yeiG | b2154 |
| CDS | − | 2242800 | 2244791 | cirA | b2155 |
| CDS | − | 2245085 | 2246554 | lysP | b2156 |
| CDS | − | 2246759 | 2247640 | yeiE | b2157 |
| CDS | + | 2247739 | 2248788 | yeiH | b2158 |
| CDS | + | 2248862 | 2249719 | nfo | b2159 |
| CDS | + | 2249722 | 2250810 | yeiI | b2160 |
| CDS | − | 2250917 | 2252167 | yeiJ | b2161 |
| CDS | − | 2252267 | 2253208 | rihB | b2162 |
| CDS | + | 2253377 | 2254036 | yeiL | b2163 |
| CDS | + | 2254107 | 2255357 | yeiM | b2164 |
| CDS | − | 2255451 | 2256389 | yeiN | b2165 |
| CDS | − | 2256377 | 2257318 | yeiC | b2166 |
| CDS | − | 2257741 | 2259432 | fruA | b2167 |
| CDS | − | 2259449 | 2260387 | fruK | b2168 |
| CDS | − | 2260387 | 2261517 | fruB | b2169 |
| CDS | + | 2261885 | 2263066 | setB | b2170 |
| CDS | + | 2263472 | 2264044 | yeiP | b2171 |
| CDS | + | 2264267 | 2265733 | yeiQ | b2172 |
| CDS | + | 2265851 | 2266837 | yeiR | b2173 |
| CDS | + | 2266876 | 2267589 | yeiU | b2174 |
| CDS | + | 2268001 | 2268567 | spr | b2175 |
| CDS | + | 2268748 | 2270304 | rtn | b2176 |
| CDS | + | 2270386 | 2272200 | yejA | b2177 |
| CDS | + | 2272201 | 2273295 | yejB | b2178 |
| CDS | + | 2273295 | 2274320 | yejE | b2179 |
| CDS | + | 2274322 | 2275911 | yejF | b2180 |
| CDS | − | 2275915 | 2276259 | yejG | b2181 |
| CDS | − | 2276592 | 2277782 | bcr | b2182 |
| CDS | − | 2277810 | 2278505 | rsuA | b2183 |
| CDS | + | 2278654 | 2280414 | yejH | b2184 |
| CDS | + | 2280539 | 2280823 | rplY | b2185 |
| CDS | − | 2280962 | 2281969 | yejK | b2186 |
| CDS | + | 2282151 | 2282378 | yejL | b2187 |
| CDS | + | 2282398 | 2284158 | yejM | b2188 |
| tRNA | + | 2284233 | 2284309 | proL | b2189 |
| CDS | − | 2284412 | 2286922 | yejO | b2190 |
| CDS | + | 2286927 | 2287049 | | b2191 |
| repeat_region | + | 2286941 | 2288135 | | |
| CDS | − | 2287087 | 2288103 | trs5_8 | b2192 |
| CDS | − | 2288522 | 2289169 | narP | b2193 |
| CDS | − | 2289380 | 2290432 | ccmH | b2194 |
| CDS | − | 2290429 | 2290986 | ccmG | b2195 |
| CDS | − | 2290983 | 2292926 | ccmF | b2196 |
| CDS | − | 2292923 | 2293402 | ccmE | b2197 |
| CDS | − | 2293399 | 2293608 | ccmD | b2198 |
| CDS | − | 2293605 | 2294342 | ccmC | b2199 |
| CDS | − | 2294384 | 2295046 | ccmB | b2200 |
| CDS | − | 2295043 | 2295666 | ccmA | b2201 |
| CDS | − | 2295679 | 2296281 | napC | b2202 |
| CDS | − | 2296291 | 2296740 | napB | b2203 |
| CDS | − | 2297126 | 2297600 | napH | b2204 |
| CDS | − | 2297587 | 2298282 | napG | b2205 |
| CDS | − | 2298289 | 2300775 | napA | b2206 |
| CDS | − | 2300772 | 2301035 | napD | b2207 |
| CDS | − | 2301025 | 2301519 | napF | b2208 |
| CDS | + | 2301927 | 2302415 | eco | b2209 |
| CDS | − | 2303130 | 2304776 | mqo | b2210 |
| CDS | − | 2304994 | 2306637 | yojI | b2211 |
| CDS | − | 2306713 | 2307363 | alkB | b2212 |
| CDS | − | 2307363 | 2308427 | ada | b2213 |
| CDS | − | 2308501 | 2309556 | yojL | b2214 |
| CDS | − | 2309668 | 2310771 | ompC | b2215 |
| CDS | + | 2311510 | 2314182 | yojN | b2216 |
| CDS | + | 2314199 | 2314849 | rcsB | b2217 |
| CDS | − | 2315049 | 2317850 | rcsC | b2218 |
| CDS | + | 2318065 | 2319891 | atoS | b2219 |
| CDS | + | 2319888 | 2321273 | atoC | b2220 |
| CDS | + | 2321469 | 2322131 | atoD | b2221 |
| CDS | + | 2322131 | 2322781 | atoA | b2222 |
| CDS | + | 2322778 | 2324100 | atoE | b2223 |
| CDS | + | 2324131 | 2325315 | atoB | b2224 |
| CDS | − | 2325389 | 2326165 | yfaP | b2225 |
| CDS | − | 2326170 | 2327819 | yfaQ | b2226 |
| CDS | − | 2327820 | 2328305 | yfaS_2 | b2227 |
| CDS | − | 2328321 | 2332424 | yfaS_1 | b2228 |
| CDS | − | 2332358 | 2332593 | yfaT | b2229 |
| CDS | − | 2332978 | 2334666 | yfaA | b2230 |
| CDS | − | 2334815 | 2337442 | gyrA | b2231 |
| CDS | + | 2337589 | 2338311 | ubiG | b2232 |
| CDS | − | 2338439 | 2342191 | yfaL | b2233 |
| CDS | + | 2342887 | 2345172 | nrdA | b2234 |

TABLE 1-continued

| Type | S | Left | Right | Name | B |
|---|---|---|---|---|---|
| CDS | + | 2345406 | 2346536 | nrdB | b2235 |
| CDS | + | 2346536 | 2346790 | yfaE | b2236 |
| CDS | − | 2346844 | 2347494 | inaA | b2237 |
| CDS | + | 2347709 | 2347915 | yfaH | b2238 |
| CDS | − | 2347957 | 2349033 | glpQ | b2239 |
| CDS | − | 2349038 | 2350396 | glpT | b2240 |
| CDS | + | 2350669 | 2352297 | glpA | b2241 |
| CDS | + | 2352287 | 2353546 | glpB | b2242 |
| CDS | + | 2353543 | 2354733 | glpC | b2243 |
| CDS | + | 2354926 | 2355825 | yfaD | b2244 |
| CDS | − | 2356064 | 2356867 |  | b2245 |
| CDS | − | 2356885 | 2358174 | yfaV | b2246 |
| CDS | − | 2358231 | 2359448 | yfaW | b2247 |
| CDS | − | 2359451 | 2360233 | yfaX | b2248 |
| CDS | − | 2360453 | 2361655 |  | b2249 |
| CDS | − | 2361755 | 2362297 | yfaZ | b2250 |
| CDS | + | 2362576 | 2363001 | yfaO | b2251 |
| CDS | − | 2363040 | 2363642 | ais | b2252 |
| CDS | + | 2363932 | 2365089 | yfbE | b2253 |
| CDS | + | 2365093 | 2366061 | yfbF | b2254 |
| CDS | + | 2366061 | 2368043 | yfbG | b2255 |
| CDS | + | 2368040 | 2368930 |  | b2256 |
| CDS | + | 2368930 | 2370582 | arnT | b2257 |
| CDS | + | 2370914 | 2371300 | yfbJ | b2258 |
| CDS | − | 2371294 | 2371560 | pmrD | b2259 |
| CDS | − | 2371670 | 2373025 | menE | b2260 |
| CDS | − | 2373022 | 2373984 | menC | b2261 |
| CDS | − | 2373984 | 2374841 | menB | b2262 |
| CDS | − | 2374856 | 2375614 | yfbB | b2263 |
| CDS | − | 2375611 | 2377281 | menD | b2264 |
| CDS | − | 2377370 | 2378665 | menF | b2265 |
| CDS | − | 2378744 | 2379049 | elaB | b2266 |
| CDS | − | 2379104 | 2379565 | elaA | b2267 |
| CDS | + | 2379630 | 2380547 | elaC | b2268 |
| CDS | + | 2380735 | 2381946 | elaD | b2269 |
| CDS | − | 2382017 | 2383744 | yfbK | b2270 |
| CDS | + | 2383882 | 2384853 | yfbL | b2271 |
| CDS | + | 2384956 | 2385459 | yfbM | b2272 |
| CDS | − | 2385732 | 2386448 | yfbN | b2273 |
| CDS | + | 2386603 | 2387079 |  | b2274 |
| CDS | + | 2387135 | 2387986 |  | b2275 |
| CDS | − | 2388070 | 2389347 | nuoN | b2276 |
| CDS | − | 2389534 | 2391063 | nuoM | b2277 |
| CDS | − | 2391227 | 2393068 | nuoL | b2278 |
| CDS | − | 2393065 | 2393367 | nuoK | b2279 |
| CDS | − | 2393364 | 2393918 | nuoJ | b2280 |
| CDS | − | 2393930 | 2394472 | nuoI | b2281 |
| CDS | − | 2394487 | 2395464 | nuoH | b2282 |
| CDS | − | 2395461 | 2398193 | nuoG | b2283 |
| CDS | − | 2398240 | 2399577 | nuoF | b2284 |
| CDS | − | 2399574 | 2400074 | nuoE | b2285 |
| CDS | − | 2400077 | 2401879 | nuoC | b2286 |
| CDS | − | 2401973 | 2402635 | nuoB | b2287 |
| CDS | − | 2402651 | 2403094 | nuoA | b2288 |
| CDS | − | 2403725 | 2404663 | lrhA | b2289 |
| CDS | + | 2405583 | 2406800 | yfbQ | b2290 |
| CDS | + | 2406884 | 2407483 |  | b2291 |
| CDS | − | 2407542 | 2409374 | yfbS | b2292 |
| CDS | − | 2409461 | 2410111 | yfbT | b2293 |
| CDS | − | 2410122 | 2410616 | yfbU | b2294 |
| CDS | − | 2410699 | 2411154 |  | b2295 |
| CDS | + | 2411492 | 2412694 | ackA | b2296 |
| CDS | + | 2412769 | 2414913 | pta | b2297 |
| CDS | + | 2415103 | 2416623 | yfcC | b2298 |
| CDS | − | 2416656 | 2417198 |  | b2299 |
| CDS | − | 2417256 | 2417810 | yfcE | b2300 |
| CDS | − | 2417863 | 2418507 | yfcF | b2301 |
| CDS | + | 2418643 | 2419290 | yfcG | b2302 |
| CDS | + | 2419104 | 2419709 | folX | b2303 |
| CDS | + | 2419730 | 2420623 | yfcH | b2304 |
| CDS | − | 2420671 | 2421561 | yfcI | b2305 |
| CDS | − | 2421758 | 2422531 | hisP | b2306 |
| CDS | − | 2422539 | 2423255 | hisM | b2307 |
| CDS | − | 2423252 | 2423938 | hisQ | b2308 |
| CDS | − | 2424028 | 2424810 | hisJ | b2309 |
| CDS | − | 2425031 | 2425813 | argT | b2310 |
| CDS | − | 2426079 | 2426648 | ubiX | b2311 |
| CDS | − | 2426743 | 2428260 | purF | b2312 |
| CDS | − | 2428297 | 2428785 | cvpA | b2313 |
| CDS | − | 2429044 | 2429706 | dedD | b2314 |
| CDS | − | 2429696 | 2430964 | folC | b2315 |
| CDS | − | 2431034 | 2431948 | accD | b2316 |
| CDS | − | 2432104 | 2432763 | dedA | b2317 |
| CDS | − | 2432846 | 2433658 | truA | b2318 |
| CDS | − | 2433658 | 2434671 | usg | b2319 |
| CDS | − | 2434737 | 2435873 | pdxB | b2320 |
| CDS | + | 2435972 | 2436967 | flk | b2321 |
| CDS | − | 2436964 | 2438142 |  | b2322 |
| CDS | − | 2438407 | 2439627 | fabB | b2323 |
| CDS | + | 2439786 | 2441792 |  | b2324 |
| CDS | − | 2441913 | 2442191 | yfcL | b2325 |
| CDS | − | 2442225 | 2442773 | yfcM | b2326 |
| CDS | − | 2442773 | 2443582 | yfcA | b2327 |
| CDS | − | 2443582 | 2444406 | mepA | b2328 |
| CDS | − | 2444410 | 2445495 | aroC | b2329 |
| CDS | − | 2445530 | 2446462 | yfcB | b2330 |
| CDS | + | 2446628 | 2447179 | yfcN | b2331 |
| CDS | − | 2447250 | 2448071 |  | b2332 |
| CDS | − | 2448073 | 2448612 | yfcP | b2333 |
| CDS | − | 2448609 | 2449097 |  | b2334 |
| CDS | − | 2449094 | 2449606 |  | b2335 |
| CDS | − | 2449606 | 2450358 | yfcS | b2336 |
| CDS | − | 2450378 | 2451274 |  | b2337 |
| CDS | − | 2451287 | 2453023 | yfcU | b2338 |
| CDS | − | 2453105 | 2453668 |  | b2339 |
| CDS | − | 2454349 | 2454834 | sixA | b2340 |
| CDS | − | 2455037 | 2457181 | yfcX | b2341 |
| CDS | − | 2457181 | 2458491 | yfcY | b2342 |
| CDS | − | 2458672 | 2458956 | yfcZ | b2343 |
| CDS | + | 2459322 | 2460668 | fadL | b2344 |
| CDS | + | 2461034 | 2462092 |  | b2345 |
| CDS | − | 2462274 | 2463029 | vacJ | b2346 |
| CDS | + | 2463323 | 2464255 | yfdC | b2347 |
| tRNA | + | 2464331 | 2464405 | argW | b2348 |
| CDS | + | 2464567 | 2465724 | intS | b2349 |
| CDS | + | 2465877 | 2466239 | yfdG | b2350 |
| CDS | + | 2466236 | 2467156 | yfdH | b2351 |
| CDS | + | 2467153 | 2468484 | yfdI | b2352 |
| CDS | + | 2468825 | 2469127 | tfaS | b2353 |
| CDS | − | 2469099 | 2469539 | yfdK | b2354 |
| CDS | − | 2469566 | 2470084 | yfdL | b2355 |
| CDS | − | 2470134 | 2470409 | yfdM | b2356 |
| CDS | − | 2470409 | 2470903 | yfdN | b2357 |
| CDS | − | 2470900 | 2471268 | yfdO | b2358 |
| CDS | + | 2471542 | 2471988 | yfdP | b2359 |
| CDS | + | 2472054 | 2472878 | yfdQ | b2360 |
| CDS | + | 2473006 | 2473542 | yfdR | b2361 |
| CDS | + | 2473533 | 2473895 | yfdS | b2362 |
| CDS | + | 2473895 | 2474200 | yfdT | b2363 |
| CDS | − | 2474716 | 2475651 | dsdC | b2364 |
| CDS | + | 2475869 | 2477206 | dsdX | b2365 |
| CDS | + | 2477224 | 2478552 | dsdA | b2366 |
| CDS | − | 2478660 | 2480198 | emrY | b2367 |
| CDS | − | 2480198 | 2481361 | emrK | b2368 |
| CDS | + | 2481777 | 2482391 | evgA | b2369 |
| CDS | + | 2482396 | 2485989 | evgS | b2370 |
| CDS | − | 2486045 | 2487190 | yfdE | b2371 |
| CDS | − | 2487264 | 2488208 | yfdV | b2372 |
| CDS | − | 2488278 | 2489972 | yfdU | b2373 |
| CDS | − | 2490026 | 2491276 | yfdW | b2374 |
| CDS | − | 2491789 | 2492424 | yfdX | b2375 |
| CDS | + | 2492720 | 2492995 | ypdI | b2376 |
| CDS | − | 2493072 | 2493314 | yfdY | b2377 |
| CDS | + | 2493667 | 2494587 | ddg | b2378 |
| CDS | − | 2495079 | 2496317 | yfdZ | b2379 |
| CDS | + | 2496693 | 2498390 | ypdA | b2380 |
| CDS | + | 2498405 | 2499139 | ypdB | b2381 |
| CDS | + | 2499152 | 2500009 | ypdC | b2382 |
| CDS | + | 2500012 | 2502507 | ypdD | b2383 |
| CDS | − | 2502532 | 2503569 | ypdE | b2384 |
| CDS | − | 2503569 | 2504654 | ypdF | b2385 |
| CDS | − | 2504669 | 2505916 | ypdG | b2386 |
| CDS | − | 2505938 | 2506264 | ypdH | b2387 |
| CDS | − | 2506483 | 2507448 | glk | b2388 |
| CDS | + | 2507652 | 2508908 | yfeO | b2389 |
| CDS | + | 2509023 | 2509349 | ypeC | b2390 |

TABLE 1-continued

| Type | S | Left | Right | Name | B |
|---|---|---|---|---|---|
| CDS | − | 2509490 | 2510728 | mntH | b2392 |
| CDS | + | 2511064 | 2512266 | nupC | b2393 |
| repeat_region | + | 2512296 | 2513638 | | |
| CDS | + | 2512353 | 2513465 | yi81_3 | b2394 |
| CDS | − | 2513665 | 2515854 | yfeA | b2395 |
| tRNA | − | 2516063 | 2516138 | alaX | b2396 |
| tRNA | − | 2516178 | 2516253 | alaW | b2397 |
| CDS | + | 2516489 | 2516833 | yfeC | b2398 |
| CDS | + | 2516835 | 2517227 | yfeD | b2399 |
| CDS | − | 2517279 | 2518694 | gltX | b2400 |
| tRNA | + | 2518953 | 2519028 | valU | b2401 |
| tRNA | + | 2519073 | 2519148 | valX | b2402 |
| tRNA | + | 2519195 | 2519270 | valY | b2403 |
| tRNA | + | 2519275 | 2519350 | lysV | b2404 |
| CDS | − | 2519615 | 2520499 | xapR | b2405 |
| CDS | − | 2520751 | 2522007 | xapB | b2406 |
| CDS | − | 2522067 | 2522900 | xapA | b2407 |
| CDS | + | 2523149 | 2523913 | yfeN | b2408 |
| CDS | − | 2523952 | 2524878 | yfeR | b2409 |
| CDS | + | 2524968 | 2525966 | yfeH | b2410 |
| CDS | − | 2526183 | 2528198 | ligA | b2411 |
| CDS | − | 2528269 | 2529255 | zipA | b2412 |
| CDS | + | 2529485 | 2530246 | cysZ | b2413 |
| CDS | + | 2530431 | 2531402 | cysK | b2414 |
| CDS | + | 2531786 | 2532043 | ptsH | b2415 |
| CDS | + | 2532088 | 2533815 | ptsI | b2416 |
| CDS | + | 2533856 | 2534365 | crr | b2417 |
| CDS | − | 2534408 | 2535259 | pdxK | b2418 |
| CDS | + | 2535364 | 2535738 | yfeK | b2419 |
| CDS | + | 2535771 | 2536505 | yfeS | b2420 |
| CDS | − | 2536694 | 2537605 | cysM | b2421 |
| CDS | − | 2537739 | 2538836 | cysA | b2422 |
| CDS | − | 2538826 | 2539701 | cysW | b2423 |
| CDS | − | 2539701 | 2540534 | cysU | b2424 |
| CDS | − | 2540534 | 2541550 | cysP | b2425 |
| CDS | − | 2541854 | 2542645 | ucpA | b2426 |
| CDS | − | 2542774 | 2543631 | yfeT | b2427 |
| CDS | + | 2543795 | 2544691 | yfeU | b2428 |
| CDS | + | 2544695 | 2546119 | yfeV | b2429 |
| CDS | + | 2546124 | 2547428 | yfeW | b2430 |
| CDS | − | 2547668 | 2548567 | yfeX | b2431 |
| CDS | − | 2548663 | 2549238 | yfeY | b2432 |
| CDS | − | 2549299 | 2549748 | yfeZ | b2433 |
| CDS | − | 2549735 | 2550160 | ypeA | b2434 |
| CDS | + | 2550374 | 2551243 | amiA | b2435 |
| CDS | + | 2551247 | 2552146 | hemF | b2436 |
| CDS | − | 2552152 | 2553204 | yfeG | b2437 |
| CDS | − | 2553250 | 2553750 | yffI | b2438 |
| CDS | − | 2553763 | 2554422 | eutL | b2439 |
| CDS | − | 2554432 | 2555319 | eutC | b2440 |
| CDS | − | 2555340 | 2556701 | eutB | b2441 |
| CDS | + | 2556793 | 2558088 | intZ | b2442 |
| CDS | − | 2558279 | 2558920 | | b2443 |
| CDS | + | 2559390 | 2559635 | | b2444 |
| CDS | + | 2559632 | 2560015 | yffN | b2445 |
| CDS | − | 2560133 | 2560549 | yffO | b2446 |
| CDS | + | 2560546 | 2561139 | | b2447 |
| CDS | + | 2561599 | 2561991 | yffQ | b2448 |
| CDS | + | 2562002 | 2562394 | | b2449 |
| CDS | + | 2562515 | 2563354 | yffS | b2450 |
| CDS | − | 2563503 | 2564906 | eutA | b2451 |
| CDS | − | 2564903 | 2556129 | eutH | b2452 |
| CDS | − | 2566346 | 2567533 | eutG | b2453 |
| CDS | − | 2567523 | 2568359 | eutJ | b2454 |
| CDS | − | 2568370 | 2569773 | eutE | b2455 |
| CDS | − | 2569785 | 2570072 | cchB | b2456 |
| CDS | − | 2570179 | 2570472 | cchA | b2457 |
| CDS | − | 2570511 | 2571527 | eutI | b2458 |
| CDS | − | 2571524 | 2572327 | eutT | b2459 |
| CDS | − | 2572324 | 2573025 | eutQ | b2460 |
| CDS | − | 2573000 | 2573479 | eutP | b2461 |
| CDS | − | 2573492 | 2573827 | ypfE | b2462 |
| CDS | − | 2574120 | 2576399 | maeB | b2463 |
| CDS | + | 2576688 | 2577638 | talA | b2464 |
| CDS | + | 2577658 | 2579661 | tktB | b2465 |
| CDS | − | 2579756 | 2580799 | ypfG | b2466 |
| CDS | − | 2580925 | 2581500 | yffH | b2467 |
| CDS | − | 2581568 | 2583547 | aegA | b2468 |
| CDS | + | 2583753 | 2585453 | narQ | b2469 |
| CDS | + | 2585617 | 2588730 | acrD | b2470 |
| CDS | + | 2589269 | 2589625 | yffB | b2471 |
| CDS | + | 2589629 | 2590756 | dapE | b2472 |
| CDS | − | 2591094 | 2591792 | ypfH | b2473 |
| CDS | − | 2591866 | 2593081 | ypfI | b2474 |
| CDS | − | 2593896 | 2594759 | | b2475 |
| CDS | − | 2594927 | 2595640 | purC | b2476 |
| CDS | − | 2595853 | 2596887 | nlpB | b2477 |
| CDS | − | 2596904 | 2597782 | dapA | b2478 |
| CDS | + | 2597928 | 2598500 | gcvR | b2479 |
| CDS | + | 2598500 | 2598970 | bcp | b2480 |
| CDS | + | 2599223 | 2599840 | hyfA | b2481 |
| CDS | + | 2599840 | 2601858 | hyfB | b2482 |
| CDS | + | 2601869 | 2602816 | hyfC | b2483 |
| CDS | + | 2602833 | 2604272 | hyfD | b2484 |
| CDS | + | 2604284 | 2604934 | hyfE | b2485 |
| CDS | + | 2604939 | 2606519 | hyfF | b2486 |
| CDS | + | 2606509 | 2608176 | hyfG | b2487 |
| CDS | + | 2608186 | 2608731 | hyfH | b2488 |
| CDS | + | 2608728 | 2609486 | hyfI | b2489 |
| CDS | + | 2609479 | 2609892 | hyfJ | b2490 |
| CDS | + | 2609922 | 2611934 | hyfR | b2491 |
| CDS | + | 2611956 | 2612804 | focB | b2492 |
| CDS | − | 2612842 | 2613903 | perM | b2493 |
| CDS | + | 2614116 | 2615579 | | b2494 |
| CDS | + | 2615600 | 2615959 | yfgD | b2495 |
| CDS | − | 2616097 | 2616843 | hda | b2496 |
| CDS | − | 2616893 | 2618182 | uraA | b2497 |
| CDS | − | 2618268 | 2618894 | upp | b2498 |
| CDS | − | 2619219 | 2620256 | purM | b2499 |
| CDS | − | 2620256 | 2620894 | purN | b2500 |
| CDS | + | 2621066 | 2623132 | ppk | b2501 |
| CDS | + | 2623137 | 2624678 | ppx | b2502 |
| CDS | − | 2624717 | 2626960 | yfgF | b2503 |
| CDS | + | 2627312 | 2627503 | yfgG | b2504 |
| CDS | + | 2627814 | 2628332 | yfgH | b2505 |
| CDS | + | 2628348 | 2628887 | yfgI | b2506 |
| CDS | − | 2628980 | 2630557 | guaA | b2507 |
| CDS | − | 2630626 | 2632092 | guaB | b2508 |
| CDS | + | 2632254 | 2633624 | xseA | b2509 |
| CDS | − | 2633621 | 2633836 | yfgJ | b2510 |
| CDS | − | 2633906 | 2635378 | yfgK | b2511 |
| CDS | − | 2635496 | 2636674 | yfgL | b2512 |
| CDS | − | 2636685 | 2637305 | yfgM | b2513 |
| CDS | + | 2637323 | 2638597 | hisS | b2514 |
| CDS | + | 2638708 | 2639826 | ispG | b2515 |
| CDS | + | 2639853 | 2640866 | yfgA | b2516 |
| CDS | + | 2641151 | 2642305 | yfgB | b2517 |
| CDS | + | 2642455 | 2642886 | ndk | b2518 |
| CDS | + | 2643035 | 2645347 | pbpC | b2519 |
| CDS | − | 2645348 | 2650309 | yfhM | b2520 |
| CDS | + | 2650516 | 2651361 | sseA | b2521 |
| CDS | + | 2652179 | 2652955 | sseB | b2522 |
| CDS | + | 2653097 | 2654380 | pepB | b2523 |
| CDS | + | 2654558 | 2654758 | yfhJ | b2524 |
| CDS | + | 2654770 | 2655105 | fdx | b2525 |
| CDS | + | 2655107 | 2656957 | hscA | b2526 |
| CDS | + | 2656974 | 2657489 | hscB | b2527 |
| CDS | + | 2657585 | 2657908 | iscA | b2528 |
| CDS | − | 2657925 | 2658311 | iscU | b2529 |
| CDS | − | 2658339 | 2659553 | iscS | b2530 |
| CDS | − | 2659665 | 2660153 | iscR | b2531 |
| CDS | + | 2660605 | 2661345 | yfhQ | b2532 |
| CDS | + | 2661464 | 2662267 | suhB | b2533 |
| CDS | + | 2662385 | 2663266 | yfhR | b2534 |
| CDS | + | 2663457 | 2664737 | csiE | b2535 |
| CDS | − | 2664729 | 2665868 | hcaT | b2536 |
| CDS | − | 2666028 | 2666918 | hcaR | b2537 |
| CDS | + | 2667054 | 2668415 | hcaE | b2538 |
| CDS | + | 2668412 | 2668930 | hcaF | b2539 |
| CDS | + | 2668930 | 2669250 | hcaC | b2540 |
| CDS | + | 2669247 | 2670059 | hcaB | b2541 |
| CDS | + | 2670069 | 2671271 | hcaD | b2542 |
| CDS | + | 2671296 | 2671790 | yphA | b2543 |
| CDS | − | 2671838 | 2672710 | yphB | b2544 |
| CDS | − | 2672722 | 2673783 | yphC | b2545 |
| CDS | − | 2673849 | 2674847 | yphD | b2546 |

TABLE 1-continued

| Type | S | Left | Right | Name | B |
|---|---|---|---|---|---|
| CDS | − | 2674872 | 2676383 | yphE | b2547 |
| CDS | − | 2676406 | 2677389 | yphF | b2548 |
| CDS | − | 2677486 | 2680767 | yphG | b2549 |
| CDS | + | 2680885 | 2682078 | yphH | b2550 |
| CDS | − | 2682276 | 2683529 | glyA | b2551 |
| CDS | + | 2683857 | 2685047 | hmpA | b2552 |
| CDS | − | 2685092 | 2685430 | glnB | b2553 |
| CDS | − | 2685491 | 2686825 | yfhA | b2554 |
| CDS | − | 2686815 | 2687528 | yfhG | b2555 |
| CDS | − | 2687693 | 2689120 | yfhK | b2556 |
| CDS | − | 2689678 | 2693565 | purL | b2557 |
| CDS | + | 2693961 | 2695379 | yfhD | b2558 |
| CDS | − | 2695376 | 2695912 | tadA | b2559 |
| CDS | − | 2695937 | 2696572 | yfhB | b2560 |
| CDS | + | 2696781 | 2697629 | yfhH | b2561 |
| CDS | + | 2697685 | 2697945 | yfhL | b2562 |
| CDS | − | 2698640 | 2699020 | acpS | b2563 |
| CDS | − | 2699020 | 2699751 | pdxJ | b2564 |
| CDS | − | 2699763 | 2700491 | recO | b2565 |
| CDS | − | 2700503 | 2701408 | era | b2566 |
| CDS | − | 2701405 | 2702085 | rnc | b2567 |
| CDS | − | 2702357 | 2703331 | lepB | b2568 |
| CDS | − | 2703347 | 2705146 | lepA | b2569 |
| CDS | − | 2705344 | 2705823 | rseC | b2570 |
| CDS | − | 2705820 | 2706776 | rseB | b2571 |
| CDS | − | 2706776 | 2707426 | rseA | b2572 |
| CDS | − | 2707459 | 2708034 | rpoE | b2573 |
| CDS | + | 2708442 | 2710064 | nadB | b2574 |
| CDS | − | 2710049 | 2710786 | yfiC | b2575 |
| CDS | + | 2710918 | 2712252 | srmB | b2576 |
| CDS | − | 2712461 | 2713342 | yfiE | b2577 |
| CDS | + | 2713445 | 2714032 | yfiK | b2578 |
| CDS | − | 2714088 | 2714471 | yfiD | b2579 |
| CDS | + | 2714776 | 2715465 | ung | b2580 |
| CDS | − | 2715513 | 2716550 | yfiF | b2581 |
| CDS | + | 2716757 | 2717176 | trxC | b2582 |
| CDS | + | 2717245 | 2717943 | yfiP | b2583 |
| CDS | + | 2717975 | 2720635 | yfiQ | b2584 |
| CDS | + | 2720749 | 2722104 | pssA | b2585 |
| CDS | + | 2722201 | 2722473 | yfiM | b2586 |
| CDS | − | 2722470 | 2723765 | kgtP | b2587 |
| rRNA | − | 2724091 | 2724210 | rrfG | b2588 |
| rRNA | − | 2724303 | 2727206 | rrlG | b2589 |
| tRNA | − | 2727391 | 2727466 | gltW | b2590 |
| rRNA | − | 2727638 | 2729179 | rrsG | b2591 |
| CDS | − | 2729622 | 2732195 | clpB | b2592 |
| CDS | − | 2732325 | 2733056 | yfiH | b2593 |
| CDS | − | 2733053 | 2734033 | rluD | b2594 |
| CDS | + | 2734168 | 2734905 | yfiO | b2595 |
| CDS | + | 2734935 | 2735141 |  | b2596 |
| CDS | + | 2735176 | 2735517 | yfiA | b2597 |
| CDS | + | 2735621 | 2735668 | pheL | b2598 |
| CDS | + | 2735767 | 2736927 | pheA | b2599 |
| CDS | − | 2736970 | 2738091 | tyrA | b2600 |
| CDS | − | 2738102 | 2739172 | aroF | b2601 |
| CDS | + | 2739382 | 2739747 | yfiL | b2602 |
| CDS | − | 2739897 | 2740415 | yfiR | b2603 |
| CDS | + | 2740405 | 2741631 | yfiN | b2604 |
| CDS | + | 2741647 | 2742129 | yfiB | b2605 |
| CDS | − | 2742205 | 2742552 | rplS | b2606 |
| CDS | − | 2742594 | 2743361 | trmD | b2607 |
| CDS | − | 2743392 | 2743940 | rimM | b2608 |
| CDS | − | 2743959 | 2744207 | rpsP | b2609 |
| CDS | − | 2744456 | 2745817 | ffh | b2610 |
| CDS | + | 2745909 | 2746775 | ypjD | b2611 |
| CDS | − | 2748137 | 2748730 | grpE | b2614 |
| CDS | + | 2748853 | 2749731 | yfjB | b2615 |
| CDS | + | 2749817 | 2751478 | recN | b2616 |
| CDS | − | 2751627 | 2751968 | smpA | b2617 |
| CDS | − | 2752030 | 2752320 | yfjF | b2618 |
| CDS | − | 2752310 | 2752786 | yfjG | b2619 |
| CDS | + | 2752918 | 2753400 | smpB | b2620 |
| misc_RNA | + | 2753615 | 2753977 | ssrA | b2621 |
| CDS | − | 2754181 | 2755422 | intA | b2622 |
| CDS | − | 2755666 | 2756622 | yfjH | b2623 |
| CDS | + | 2756666 | 2756878 | alpA | b2624 |
| CDS | + | 2757007 | 2758416 | yfjI | b2625 |
| CDS | + | 2758569 | 2759195 | yfjJ | b2626 |
| CDS | − | 2759373 | 2761562 | yfjK | b2627 |
| CDS | − | 2761559 | 2763175 | yfjL | b2628 |
| CDS | − | 2763535 | 2763798 | yfjM | b2629 |
| CDS | + | 2763940 | 2765013 | yfjN | b2630 |
| CDS | + | 2765006 | 2765377 | yfjO | b2631 |
| CDS | + | 2765732 | 2766595 | yfjP | b2632 |
| CDS | + | 2766687 | 2767508 | yfjQ | b2633 |
| CDS | + | 2767725 | 2768426 | yfjR | b2634 |
| CDS | + | 2768467 | 2768703 | ypjK | b2635 |
| CDS | + | 2768703 | 2769146 | yfjS | b2636 |
| CDS | + | 2769170 | 2769637 | yfjT | b2637 |
| CDS | − | 2769862 | 2770176 | yfjU | b2638 |
| CDS | − | 2770189 | 2770707 |  | b2639 |
| CDS | − | 2770858 | 2771058 |  | b2640 |
| CDS | − | 2770998 | 2771180 |  | b2641 |
| CDS | + | 2771340 | 2773043 | yfjW | b2642 |
| CDS | + | 2773941 | 2774399 | yfjX | b2643 |
| CDS | + | 2774408 | 2774890 | yfjY | b2644 |
| CDS | + | 2775137 | 2775454 | yfjZ | b2645 |
| CDS | + | 2775475 | 2775804 | ypjF | b2646 |
| CDS | − | 2776168 | 2780748 | ypjA | b2647 |
| CDS | − | 2781087 | 2781230 | pinH | b2648 |
| CDS | − | 2781660 | 2782451 |  | b2649 |
| CDS | − | 2782551 | 2783033 |  | b2650 |
| CDS | + | 2783243 | 2783374 |  | b2651 |
| tRNA | − | 2783784 | 2783859 | ileY | b2652 |
| CDS | − | 2783822 | 2783995 |  | b2653 |
| CDS | + | 2784419 | 2784751 |  | b2654 |
| CDS | + | 2785664 | 2786260 |  | b2657 |
| CDS | + | 2786399 | 2786671 |  | b2658 |
| CDS | + | 2787007 | 2787984 |  | b2659 |
| CDS | + | 2788004 | 2789272 | ygaF | b2660 |
| CDS | + | 2789295 | 2790743 | gabD | b2661 |
| CDS | + | 2790757 | 2792037 | gabT | b2662 |
| CDS | + | 2792275 | 2793675 | gabP | b2663 |
| CDS | + | 2793696 | 2794358 | ygaE | b2664 |
| CDS | − | 2794359 | 2794808 | ygaU | b2665 |
| CDS | − | 2794892 | 2795050 | yqaE | b2666 |
| CDS | + | 2795233 | 2795532 |  | b2667 |
| CDS | + | 2795542 | 2796066 | ygaP | b2668 |
| CDS | − | 2796113 | 2796517 | stpA | b2669 |
| CDS | + | 2797186 | 2797635 |  | b2670 |
| CDS | − | 2797672 | 2798016 | ygaC | b2671 |
| CDS | + | 2798156 | 2798497 | ygaM | b2672 |
| CDS | + | 2798745 | 2798990 | nrdH | b2673 |
| CDS | + | 2798987 | 2799397 | nrdI | b2674 |
| CDS | + | 2799370 | 2801514 | nrdE | b2675 |
| CDS | + | 2801524 | 2802483 | nrdF | b2676 |
| CDS | + | 2802837 | 2804039 | proV | b2677 |
| CDS | + | 2804032 | 2805096 | proW | b2678 |
| CDS | + | 2805154 | 2806146 | proX | b2679 |
| CDS | + | 2806338 | 2806604 |  | b2680 |
| CDS | + | 2806634 | 2807515 |  | b2681 |
| CDS | + | 2807639 | 2808376 | ygaZ | b2682 |
| CDS | + | 2808366 | 2808701 | ygaH | b2683 |
| CDS | + | 2808792 | 2809322 | emrR | b2684 |
| CDS | + | 2809449 | 2810621 | emrA | b2685 |
| CDS | + | 2810638 | 2812176 | emrB | b2686 |
| CDS | − | 2812240 | 2812755 | ygaG | b2687 |
| CDS | − | 2812905 | 2814461 | gshA | b2688 |
| CDS | − | 2814534 | 2814962 | yqaA | b2689 |
| CDS | − | 2814959 | 2815525 | yqaB | b2690 |
| tRNA | − | 2815806 | 2815882 | argQ | b2691 |
| tRNA | − | 2816081 | 2816157 | argZ | b2692 |
| tRNA | − | 2816220 | 2816296 | argY | b2693 |
| tRNA | − | 2816495 | 2816571 | argV | b2694 |
| tRNA | − | 2816575 | 2816667 | serV | b2695 |
| CDS | − | 2816983 | 2817168 | csrA | b2696 |
| CDS | − | 2817403 | 2820033 | alaS | b2697 |
| CDS | − | 2820161 | 2820661 | oraA | b2698 |
| CDS | − | 2820730 | 2821791 | recA | b2699 |
| CDS | − | 2821871 | 2822368 | ygaD | b2700 |
| CDS | − | 2822513 | 2823598 | mltB | b2701 |
| CDS | + | 2823854 | 2824417 | srlA | b2702 |
| CDS | + | 2824414 | 2825373 | srlE | b2703 |
| CDS | + | 2825384 | 2825755 | srlB | b2704 |
| CDS | + | 2825759 | 2826538 | srlD | b2705 |
| CDS | + | 2826643 | 2827002 | gutM | b2706 |

TABLE 1-continued

| Type | S | Left | Right | Name | B |
|---|---|---|---|---|---|
| CDS | + | 2827069 | 2827842 | srlR | b2707 |
| CDS | + | 2827835 | 2828800 | gutQ | b2708 |
| CDS | − | 2828797 | 2830311 | ygaA | b2709 |
| CDS | + | 2830498 | 2831937 | norV | b2710 |
| CDS | + | 2831934 | 2833067 | ygbD | b2711 |
| CDS | − | 2833195 | 2835447 | hypF | b2712 |
| CDS | − | 2835600 | 2836127 | hydN | b2713 |
| CDS | − | 2836276 | 2837289 | ascG | b2714 |
| CDS | + | 2837546 | 2839003 | ascF | b2715 |
| CDS | + | 2839012 | 2840436 | ascB | b2716 |
| CDS | − | 2840595 | 2841065 | hycI | b2717 |
| CDS | − | 2841058 | 2841468 | hycH | b2718 |
| CDS | − | 2841465 | 2842232 | hycG | b2719 |
| CDS | − | 2842232 | 2842774 | hycF | b2720 |
| CDS | − | 2842784 | 2844493 | hycE | b2721 |
| CDS | − | 2844511 | 2845434 | hycD | b2722 |
| CDS | − | 2845437 | 2847263 | hycC | b2723 |
| CDS | − | 2847260 | 2847871 | hycB | b2724 |
| CDS | − | 2847996 | 2848457 | hycA | b2725 |
| CDS | + | 2848669 | 2849019 | hypA | b2726 |
| CDS | + | 2849023 | 2849895 | hypB | b2727 |
| CDS | + | 2849886 | 2850158 | hypC | b2728 |
| CDS | + | 2850158 | 2851279 | hypD | b2729 |
| CDS | + | 2851318 | 2852286 | hypE | b2730 |
| CDS | + | 2852360 | 2854438 | fhlA | b2731 |
| CDS | − | 2854475 | 2854828 | ygbA | b2732 |
| CDS | + | 2855115 | 2857676 | mutS | b2733 |
| CDS | + | 2857782 | 2858438 | pphB | b2734 |
| CDS | − | 2858489 | 2859286 | ygbI | b2735 |
| CDS | + | 2859452 | 2860360 | ygbJ | b2736 |
| CDS | + | 2860357 | 2861523 | ygbK | b2737 |
| CDS | + | 2861615 | 2862253 | ygbL | b2738 |
| CDS | + | 2862258 | 2863034 | ygbM | b2739 |
| CDS | + | 2863123 | 2864487 | ygbN | b2740 |
| CDS | − | 2864581 | 2865573 | rpoS | b2741 |
| CDS | − | 2865636 | 2866775 | nlpD | b2742 |
| CDS | − | 2866915 | 2867541 | pcm | b2743 |
| CDS | − | 2867535 | 2868296 | surE | b2744 |
| CDS | − | 2868277 | 2869326 | ygbO | b2745 |
| CDS | − | 2869323 | 2869802 | ispF | b2746 |
| CDS | − | 2869802 | 2870512 | ispD | b2747 |
| CDS | − | 2870531 | 2870842 | ygbQ | b2748 |
| CDS | − | 2871036 | 2871359 | ygbE | b2749 |
| CDS | − | 2871409 | 2872014 | cysC | b2750 |
| CDS | − | 2872014 | 2873441 | cysN | b2751 |
| CDS | − | 2873443 | 2874351 | cysD | b2752 |
| CDS | + | 2874603 | 2875640 | iap | b2753 |
| CDS | − | 2876591 | 2876875 | ygbF | b2754 |
| CDS | − | 2876877 | 2877794 | ygbT | b2755 |
| CDS | − | 2877810 | 2878409 | ygcH | b2756 |
| CDS | − | 2878396 | 2879070 | ygcI | b2757 |
| CDS | − | 2879073 | 2880164 | ygcJ | b2758 |
| CDS | − | 2880177 | 2880659 | ygcK | b2759 |
| CDS | − | 2880652 | 2882160 | ygcL | b2760 |
| CDS | − | 2882575 | 2885241 | ygcB | b2761 |
| CDS | − | 2885600 | 2886334 | cysH | b2762 |
| CDS | − | 2886409 | 2888121 | cysI | b2763 |
| CDS | − | 2888121 | 2889920 | cysJ | b2764 |
| CDS | + | 2890236 | 2890601 | ygcM | b2765 |
| CDS | + | 2890679 | 2891950 | ygcN | b2766 |
| CDS | + | 2891941 | 2892201 | ygcO | b2767 |
| CDS | + | 2892218 | 2892793 | ygoP | b2768 |
| CDS | − | 2892941 | 2893801 | ygcQ | b2769 |
| CDS | − | 2893798 | 2894577 | ygcR | b2770 |
| CDS | − | 2894555 | 2895892 | ygcS | b2771 |
| CDS | − | 2897510 | 2898295 | ygcW | b2774 |
| CDS | + | 2898614 | 2899891 | yqcE | b2775 |
| CDS | + | 2899918 | 2901396 | ygcE | b2776 |
| CDS | − | 2902769 | 2903440 | ygcF | b2777 |
| CDS | + | 2903733 | 2904605 | ygcG | b2778 |
| CDS | − | 2904665 | 2905963 | eno | b2779 |
| CDS | − | 2906051 | 2907688 | pyrG | b2780 |
| CDS | − | 2907916 | 2908707 | mazF | b2781 |
| CDS | − | 2908778 | 2909113 | chpA | b2782 |
| CDS | − | 2909113 | 2909361 | chpR | b2783 |
| CDS | − | 2909439 | 2911673 | relA | b2784 |
| CDS | − | 2911721 | 2913022 | rumA | b2785 |
| CDS | + | 2913079 | 2915835 | barA | b2786 |
| CDS | − | 2916067 | 2917407 | gudD | b2787 |
| CDS | − | 2917428 | 2918768 | gudX | b2788 |
| CDS | − | 2918770 | 2920122 | gudP | b2789 |
| CDS | − | 2920557 | 2921006 | yqcA | b2790 |
| CDS | − | 2921024 | 2921806 | yqcB | b2791 |
| CDS | − | 2921806 | 2922135 | yqcC | b2792 |
| CDS | − | 2922757 | 2923302 | syd | b2793 |
| CDS | + | 2923370 | 2924218 | yqcD | b2794 |
| CDS | + | 2924330 | 2925694 | ygdH | b2795 |
| CDS | + | 2926251 | 2927540 | sdaC | b2796 |
| CDS | + | 2927598 | 2928965 | sdaB | b2797 |
| CDS | + | 2928987 | 2929832 | exo | b2798 |
| CDS | − | 2929887 | 2931038 | fucO | b2799 |
| CDS | − | 2931063 | 2931710 | fucA | b2800 |
| CDS | + | 2932257 | 2933573 | fucP | b2801 |
| CDS | + | 2933606 | 2935381 | fucI | b2802 |
| CDS | + | 2935460 | 2936908 | fucK | b2803 |
| CDS | + | 2936910 | 2937332 | fucU | b2804 |
| CDS | + | 2937390 | 2936121 | fucR | b2805 |
| CDS | − | 2938165 | 2939265 | ygdE | b2806 |
| CDS | − | 2939258 | 2939653 | ygdD | b2807 |
| CDS | − | 2939672 | 2940589 | gcvA | b2808 |
| CDS | − | 2940940 | 2941167 | ygdI | b2809 |
| CDS | + | 2941359 | 2942564 | csdA | b2810 |
| CDS | + | 2942564 | 2943007 | ygdK | b2811 |
| CDS | + | 2943058 | 2943864 | ygdL | b2812 |
| CDS | − | 2944103 | 2945200 | mltA | b2813 |
| tRNA | + | 2945409 | 2945485 | metZ | b2814 |
| tRNA | + | 2945519 | 2945595 | metW | b2815 |
| tRNA | + | 2945629 | 2945705 | metV | b2816 |
| CDS | − | 2945779 | 2947032 | amiC | b2817 |
| CDS | + | 2947264 | 2948595 | argA | b2818 |
| CDS | + | 2948657 | 2950483 | recD | b2819 |
| CDS | + | 2950483 | 2954025 | recB | b2820 |
| CDS | − | 2954018 | 2956906 | ptr | b2821 |
| CDS | − | 2957062 | 2960450 | recC | b2822 |
| CDS | − | 2960463 | 2960786 | ppdC | b2823 |
| CDS | − | 2960771 | 2961178 | ygdB | b2824 |
| CDS | − | 2961175 | 2961738 | ppdB | b2825 |
| CDS | − | 2961729 | 2962199 | ppdA | b2826 |
| CDS | − | 2962383 | 2963177 | thyA | b2827 |
| CDS | − | 2963184 | 2964059 | lgt | b2828 |
| CDS | − | 2964210 | 2966456 | ptsP | b2829 |
| CDS | − | 2966469 | 2966999 | ygdP | b2830 |
| CDS | + | 2967684 | 2968373 | mutH | b2831 |
| CDS | + | 2968442 | 2969155 | ygdQ | b2832 |
| CDS | + | 2969293 | 2969511 | ygdR | b2833 |
| CDS | + | 2969619 | 2970659 | tas | b2834 |
| CDS | − | 2970691 | 2971884 | ygeD | b2835 |
| CDS | − | 2971877 | 2974036 | aas | b2836 |
| CDS | + | 2974621 | 2975652 | galR | b2837 |
| CDS | − | 2975659 | 2976921 | lysA | b2838 |
| CDS | + | 2977043 | 2977978 | lysR | b2839 |
| CDS | + | 2977965 | 2978657 | ygeA | b2840 |
| CDS | − | 2978786 | 2980204 | araE | b2841 |
| CDS | − | 2980519 | 2981280 | kduD | b2842 |
| CDS | − | 2981310 | 2982146 | kduI | b2843 |
| CDS | − | 2982433 | 2983614 | yqeF | b2844 |
| CDS | + | 2983869 | 2985098 | yqeG | b2845 |
| CDS | + | 2985558 | 2986190 | yqeH | b2846 |
| CDS | + | 2986524 | 2987333 | yqeI | b2847 |
| CDS | + | 2987326 | 2987808 | yqeJ | b2848 |
| CDS | − | 2987957 | 2988382 | yqeK | b2849 |
| CDS | + | 2988576 | 2989022 | ygeF | b2850 |
| CDS | + | 2989290 | 2989781 | ygeG | b2851 |
| CDS | + | 2990116 | 2991492 | ygeH | b2852 |
| CDS | + | 2991660 | 2991878 | ygeI | b2853 |
| CDS | + | 2992063 | 2992437 |  | b2854 |
| CDS | − | 2992482 | 2992925 | ygeK | b2855 |
| CDS | + | 2992959 | 2993114 |  | b2856 |
| CDS | − | 2993336 | 2993767 |  | b2857 |
| CDS | − | 2993770 | 2994042 |  | b2858 |
| CDS | − | 2993984 | 2994409 |  | b2859 |
| repeat_region | + | 2994383 | 2995713 |  |  |
| CDS | − | 2994394 | 2995299 | yi22_4 | b2860 |
| CDS | − | 2995257 | 2995667 | yi21_4 | b2861 |
| CDS | − | 2995711 | 2996010 | ygeP | b2862 |
| CDS | − | 2996056 | 2996850 | ygeQ | b2863 |

TABLE 1-continued

| Type | S | Left | Right | Name | B |
|---|---|---|---|---|---|
| tRNA | − | 2997006 | 2997079 | glyU | b2864 |
| CDS | − | 2997158 | 2997913 | ygeR | b2865 |
| CDS | + | 2998367 | 3000625 | xdhA | b2866 |
| CDS | + | 3000636 | 3001514 | xdhB | b2867 |
| CDS | + | 3001511 | 3001990 | xdhC | b2868 |
| CDS | − | 3002030 | 3003808 | ygeV | b2869 |
| CDS | − | 3004284 | 3005474 | ygeW | b2870 |
| CDS | + | 3005532 | 3006728 | ygeX | b2871 |
| CDS | + | 3006786 | 3007997 | ygeY | b2872 |
| CDS | + | 3008050 | 3009435 | ygeZ | b2873 |
| CDS | + | 3009483 | 3010415 | yqeA | b2874 |
| CDS | − | 3010636 | 3012261 | yqeB | b2875 |
| CDS | − | 3012309 | 3013079 | yqeC | b2876 |
| CDS | + | 3013182 | 3013760 | ygfJ | b2877 |
| CDS | + | 3014082 | 3017180 | ygfK | b2878 |
| CDS | + | 3017183 | 3018511 | ssnA | b2879 |
| CDS | + | 3018562 | 3019341 | ygfM | b2880 |
| CDS | + | 3019338 | 3022208 | xdhD | b2881 |
| CDS | + | 3022373 | 3023773 | ygfO | b2882 |
| CDS | + | 3023788 | 3025107 | guaD | b2883 |
| CDS | − | 3026546 | 3027034 | ygfS | b2886 |
| CDS | − | 3027034 | 3028953 | ygfT | b2887 |
| CDS | − | 3029389 | 3030837 | ygfU | b2888 |
| CDS | + | 3031087 | 3031635 | idi | b2889 |
| CDS | − | 3031679 | 3033196 | lysS | b2890 |
| CDS | − | 3033206 | 3034304 | prfB | b2891 |
| CDS | − | 3034395 | 3036128 | recJ | b2892 |
| CDS | − | 3036134 | 3036844 | dsbC | b2893 |
| CDS | − | 3036869 | 3037765 | xerD | b2894 |
| CDS | + | 3037877 | 3038398 | fldB | b2895 |
| CDS | − | 3038438 | 3038845 | ygfX | b2896 |
| CDS | − | 3038826 | 3039092 | ygfY | b2897 |
| CDS | + | 3039335 | 3040315 | ygfZ | b2898 |
| CDS | − | 3040511 | 3041170 | yqfA | b2899 |
| CDS | − | 3041334 | 3041645 | yqfB | b2900 |
| CDS | + | 3041684 | 3043123 | bglA | b2901 |
| CDS | − | 3043180 | 3043923 | ygfF | b2902 |
| CDS | − | 3044190 | 3047063 | gcvP | b2903 |
| CDS | − | 3047182 | 3047571 | gcvH | b2904 |
| CDS | − | 3047595 | 3048689 | gcvT | b2905 |
| CDS | − | 3049137 | 3050339 | visC | b2906 |
| CDS | − | 3050362 | 3051540 | ubiH | b2907 |
| CDS | − | 3051537 | 3052862 | pepP | b2908 |
| CDS | − | 3052888 | 3053466 | ygfB | b2909 |
| CDS | + | 3053634 | 3053963 | ygfE | b2910 |
| misc_RNA | + | 3054005 | 3054187 | ssrS | b2911 |
| CDS | + | 3054263 | 3054811 | ygfA | b2912 |
| CDS | − | 3055200 | 3056432 | serA | b2913 |
| CDS | − | 3056688 | 3057347 | rpiA | b2914 |
| CDS | − | 3057403 | 3057633 | yqfE | b2915 |
| CDS | + | 3057775 | 3058668 | iciA | b2916 |
| CDS | + | 3058872 | 3061016 | sbm | b2917 |
| CDS | + | 3061009 | 3062004 | argK | b2918 |
| CDS | + | 3062015 | 3062800 | ygfG | b2919 |
| CDS | + | 3062824 | 3064302 | ygfH | b2920 |
| CDS | − | 3064299 | 3065195 | ygfI | b2921 |
| CDS | − | 3065362 | 3066102 | yggE | b2922 |
| CDS | − | 3066195 | 3066830 | yggA | b2923 |
| CDS | − | 3066969 | 3067829 | yggB | b2924 |
| CDS | − | 3068187 | 3069266 | ybaA | b2925 |
| CDS | − | 3069481 | 3070644 | pgk | b2926 |
| CDS | − | 3070694 | 3071713 | epd | b2927 |
| CDS | − | 3071998 | 3072711 | yggC | b2928 |
| CDS | − | 3072708 | 3073217 | yggD | b2929 |
| CDS | − | 3073239 | 3074204 | yggF | b2930 |
| CDS | − | 3075493 | 3076881 | cmtA | b2933 |
| CDS | − | 3076909 | 3077352 | cmtB | b2934 |
| CDS | − | 3077666 | 3079657 | tktA | b2935 |
| CDS | + | 3079935 | 3080693 | yggG | b2936 |
| CDS | − | 3080899 | 3081819 | speB | b2937 |
| CDS | − | 3081957 | 3083933 | speA | b2938 |
| CDS | − | 3083942 | 3084088 | yqgB | b2939 |
| CDS | − | 3084209 | 3084424 | yqgC | b2940 |
| CDS | + | 3084421 | 3084672 | yqgD | b2941 |
| CDS | − | 3084728 | 3085882 | metK | b2942 |
| CDS | + | 3086306 | 3087700 | galP | b2943 |
| CDS | + | 3087777 | 3088274 | sprT | b2944 |
| CDS | + | 3088369 | 3089076 | endA | b2945 |
| CDS | + | 3089156 | 3089887 | yggJ | b2946 |
| CDS | + | 3089900 | 3090850 | gshB | b2947 |
| CDS | + | 3090959 | 3091522 | yqgE | b2948 |
| CDS | + | 3091522 | 3091938 | yqgF | b2949 |
| CDS | − | 3092122 | 3093102 | yggR | b2950 |
| CDS | + | 3093120 | 3093824 | yggS | b2951 |
| CDS | + | 3093842 | 3094408 | yggT | b2952 |
| CDS | + | 3094405 | 3094695 | yggU | b2953 |
| CDS | + | 3094703 | 3095296 | yggV | b2954 |
| CDS | + | 3095289 | 3096425 | yggW | b2955 |
| CDS | − | 3096580 | 3097587 | yggM | b2956 |
| CDS | − | 3097704 | 3098750 | ansB | b2957 |
| CDS | − | 3098926 | 3099645 | yggN | b2958 |
| CDS | − | 3099829 | 3100155 | yggL | b2959 |
| CDS | − | 3100155 | 3100874 | yggH | b2960 |
| CDS | + | 3101035 | 3102087 | mutY | b2961 |
| CDS | + | 3102115 | 3102390 | yggX | b2962 |
| CDS | + | 3102455 | 3103534 | mltC | b2963 |
| CDS | + | 3103736 | 3104992 | nupG | b2964 |
| CDS | − | 3105042 | 3107177 | speC | b2965 |
| CDS | + | 3107575 | 3108282 | yqgA | b2966 |
| tRNA | + | 3108388 | 3108463 | pheV | b2967 |
| CDS | − | 3108612 | 3109148 | yghD | b2968 |
| CDS | − | 3109150 | 3110010 | yghE | b2969 |
| CDS | − | 3110076 | 3110942 | yghF | b2970 |
| CDS | − | 3111089 | 3111499 | yghG | b2971 |
| CDS | − | 3111565 | 3112374 | pppA | b2972 |
| CDS | − | 3117619 | 3119301 | yghK | b2975 |
| CDS | − | 3119656 | 3121827 | glcB | b2976 |
| CDS | − | 3121849 | 3122253 | glcG | b2977 |
| CDS | − | 3124544 | 3126043 | glcD | b2979 |
| CDS | + | 3126294 | 3127058 | glcC | b2980 |
| CDS | − | 3127065 | 3128237 | yghO | b2981 |
| repeat_region | − | 3128168 | 3129362 | | |
| CDS | + | 3128200 | 3129216 | trs5_9 | b2982 |
| CDS | − | 3129263 | 3130430 | yghQ | b2983 |
| CDS | − | 3130476 | 3131234 | yghR | b2984 |
| CDS | − | 3131266 | 3131979 | yghS | b2985 |
| CDS | + | 3132153 | 3132845 | yghT | b2986 |
| CDS | − | 3132894 | 3134393 | pitB | b2987 |
| CDS | − | 3134685 | 3136544 | gss | b2988 |
| CDS | + | 3136749 | 3137615 | yghU | b2989 |
| CDS | − | 3137738 | 3137986 | hybG | b2990 |
| CDS | − | 3137999 | 3138340 | hybF | b2991 |
| CDS | − | 3138333 | 3138821 | hybE | b2992 |
| CDS | − | 3138814 | 3139308 | hybD | b2993 |
| CDS | − | 3139308 | 3141011 | hybC | b2994 |
| CDS | − | 3141008 | 3142186 | hybB | b2995 |
| CDS | − | 3142176 | 3143162 | hybA | b2996 |
| CDS | − | 3143165 | 3144283 | hybO | b2997 |
| CDS | − | 3144472 | 3144759 | yghW | b2998 |
| CDS | − | 3144878 | 3145288 | | b2999 |
| CDS | − | 3145288 | 3145641 | | b3000 |
| CDS | + | 3145919 | 3146959 | yghZ | b3001 |
| CDS | + | 3146999 | 3147493 | yqhA | b3002 |
| CDS | + | 3147684 | 3148568 | yghA | b3003 |
| CDS | + | 3148744 | 3148989 | | b3004 |
| CDS | + | 3148840 | 3149265 | exbD | b3005 |
| CDS | − | 3149272 | 3150006 | exbB | b3006 |
| CDS | − | 3149999 | 3150154 | | b3007 |
| CDS | + | 3150258 | 3151445 | metC | b3008 |
| CDS | + | 3151585 | 3152244 | yghB | b3009 |
| CDS | + | 3152284 | 3153240 | yqhC | b3010 |
| CDS | + | 3153377 | 3154540 | yqhD | b3011 |
| CDS | + | 3154645 | 3155472 | dkgA | b3012 |
| CDS | + | 3155672 | 3156598 | yqhG | b3013 |
| CDS | + | 3156649 | 3156906 | yqhH | b3014 |
| CDS | − | 3159279 | 3160691 | sufI | b3017 |
| CDS | − | 3160766 | 3161503 | plsC | b3018 |
| CDS | − | 3161737 | 3163995 | parC | b3019 |
| CDS | − | 3164133 | 3165740 | ygiS | b3020 |
| CDS | − | 3165873 | 3166268 | ygiT | b3021 |
| CDS | − | 3166270 | 3166566 | ygiU | b3022 |
| CDS | − | 3166771 | 3167253 | | b3023 |
| CDS | + | 3167306 | 3167696 | ygiW | b3024 |
| CDS | + | 3167850 | 3168509 | ygiX | b3025 |
| CDS | + | 3168506 | 3169855 | ygiY | b3026 |
| CDS | − | 3169901 | 3170233 | ygiZ | b3027 |

TABLE 1-continued

| Type | S | Left | Right | Name | B |
|---|---|---|---|---|---|
| CDS | + | 3170552 | 3171133 | mdaB | b3028 |
| CDS | + | 3171164 | 3171478 | ygiN | b3029 |
| CDS | − | 3171526 | 3173418 | parE | b3030 |
| CDS | − | 3173447 | 3174028 | yqiA | b3031 |
| CDS | − | 3174028 | 3174855 | cpdA | b3032 |
| CDS | − | 3174880 | 3175302 | yqiB | b3033 |
| CDS | − | 3175303 | 3175932 | yqiE | b3034 |
| CDS | + | 3176137 | 3177618 | tolC | b3035 |
| CDS | + | 3177618 | 3177878 | ygiA | b3036 |
| CDS | + | 3177862 | 3178437 | ygiB | b3037 |
| CDS | + | 3178443 | 3179603 | ygiC | b3038 |
| CDS | − | 3179641 | 3180456 | YgiD | b3039 |
| CDS | + | 3180572 | 3181345 | ygiE | b3040 |
| CDS | − | 3181835 | 3182488 | ribB | b3041 |
| CDS | + | 3182862 | 3183152 | yqiC | b3042 |
| CDS | + | 3183436 | 3183987 | ygiL | b3043 |
| repeat_region | − | 3184118 | 3185448 | | |
| CDS | + | 3184164 | 3184574 | yi21_5 | b3044 |
| CDS | + | 3184532 | 3185437 | yi22_5 | b3045 |
| CDS | + | 3185422 | 3187887 | yqiG | b3046 |
| CDS | + | 3187903 | 3188652 | yqiH | b3047 |
| CDS | + | 3188654 | 3189718 | yqiI | b3048 |
| CDS | − | 3189761 | 3189961 | glgS | b3049 |
| CDS | + | 3190230 | 3190859 | yqiJ | b3050 |
| CDS | + | 3190886 | 3192547 | yqiK | b3051 |
| CDS | − | 3193342 | 3194775 | rfaE | b3052 |
| CDS | − | 3194823 | 3197663 | glnE | b3053 |
| CDS | − | 3197686 | 3198987 | ygiF | b3054 |
| CDS | + | 3199229 | 3199849 | ygiM | b3055 |
| CDS | + | 3199913 | 3201151 | cca | b3056 |
| CDS | − | 3201332 | 3202153 | bacA | b3057 |
| CDS | − | 3202243 | 3202611 | ygiG | b3058 |
| CDS | + | 3202716 | 3203333 | ygiH | b3059 |
| CDS | − | 3203346 | 3204278 | ygiP | b3060 |
| CDS | + | 3204485 | 3205396 | ttdA | b3061 |
| CDS | + | 3205393 | 3205998 | ttdB | b3062 |
| CDS | + | 3206046 | 3207509 | ygjE | b3063 |
| CDS | − | 3207552 | 3208565 | ygjD | b3064 |
| CDS | + | 3208803 | 3209018 | rpsU | b3065 |
| CDS | + | 3209129 | 3210874 | dnaG | b3066 |
| CDS | + | 3211069 | 3212910 | rpoD | b3067 |
| CDS | − | 3212989 | 3213495 | ygjF | b3068 |
| tRNA | + | 3213620 | 3213695 | ileX | b3069 |
| CDS | − | 3213749 | 3214513 | ygjH | b3070 |
| CDS | + | 3214801 | 3215424 | yqjI | b3071 |
| CDS | − | 3215578 | 3217098 | aer | b3072 |
| CDS | + | 3217489 | 3218895 | ygjG | b3073 |
| CDS | + | 3218937 | 3219269 | ygjH | b3074 |
| CDS | + | 3219488 | 3220471 | ebgR | b3075 |
| CDS | + | 3220655 | 3223747 | ebgA | b3076 |
| CDS | + | 3223744 | 3224193 | ebgC | b3077 |
| CDS | + | 3224256 | 3225689 | ygjI | b3078 |
| CDS | + | 3225823 | 3226893 | ygjJ | b3079 |
| CDS | + | 3226910 | 3229261 | ygjK | b3080 |
| CDS | + | 3229687 | 3231705 | fadH | b3081 |
| CDS | − | 3231750 | 3232166 | ygjM | b3082 |
| CDS | − | 3232163 | 3232477 | ygjN | b3083 |
| CDS | − | 3232761 | 3233897 | ygjO | b3084 |
| CDS | + | 3233982 | 3234485 | ygjP | b3085 |
| CDS | − | 3234562 | 3235254 | ygjQ | b3086 |
| CDS | + | 3235315 | 3236319 | ygjS | b3087 |
| CDS | + | 3236602 | 3237567 | ygjT | b3088 |
| CDS | + | 3237966 | 3239210 | ygjU | b3089 |
| CDS | − | 3239215 | 3239766 | ygjV | b3090 |
| CDS | − | 3239849 | 3241336 | uxaA | b3091 |
| CDS | − | 3241351 | 3242763 | uxaC | b3092 |
| CDS | + | 3243126 | 3244544 | exuT | b3093 |
| CDS | + | 3244674 | 3245450 | exuR | b3094 |
| CDS | − | 3245795 | 3246457 | yqjA | b3095 |
| CDS | − | 3246461 | 3246844 | yqjB | b3096 |
| CDS | − | 3246991 | 3247359 | yqjC | b3097 |
| CDS | − | 3247397 | 3247702 | yqjD | b3098 |
| CDS | − | 3247705 | 3248109 | yqjE | b3099 |
| CDS | − | 3248099 | 3248398 | yqjK | b3100 |
| CDS | − | 3248584 | 3248976 | yqjF | b3101 |
| CDS | + | 3249046 | 3250032 | yqjG | b3102 |
| CDS | + | 3250326 | 3250691 | yhaH | b3103 |
| CDS | + | 3250933 | 3251289 | yhaI | b3104 |
| CDS | − | 3251340 | 3252236 | yhaJ | b3105 |
| CDS | + | 3252341 | 3253042 | yhaK | b3106 |
| CDS | + | 3253065 | 3253229 | yhaL | b3107 |
| CDS | − | 3254701 | 3255969 | yhaO | b3110 |
| CDS | − | 3257743 | 3258132 | tdcF | b3113 |
| CDS | − | 3258146 | 3260440 | tdcE | b3114 |
| CDS | − | 3260474 | 3261694 | tdcD | b3115 |
| CDS | − | 3261708 | 3263039 | tdcC | b3116 |
| CDS | − | 3263061 | 3264050 | tdcB | b3117 |
| CDS | − | 3264149 | 3265087 | tdcA | b3118 |
| CDS | + | 3265402 | 3265620 | tdcR | b3119 |
| CDS | + | 3265876 | 3266415 | yhaB | b3120 |
| CDS | + | 3266437 | 3267624 | yhaC | b3121 |
| misc_RNA | − | 3268238 | 3268614 | rnpB | b3123 |
| CDS | − | 3268621 | 3269873 | garK | b3124 |
| CDS | − | 3269889 | 3270779 | garR | b3125 |
| CDS | − | 3270809 | 3271579 | garL | b3126 |
| CDS | − | 3271595 | 3272929 | garP | b3127 |
| CDS | + | 3273304 | 3274875 | garD | b3128 |
| CDS | + | 3275024 | 3275359 | sohA | b3129 |
| CDS | + | 3275359 | 3275823 | yhaV | b3130 |
| CDS | − | 3275878 | 3276687 | agaR | b3131 |
| CDS | + | 3276936 | 3278216 | agaZ | b3132 |
| CDS | + | 3278239 | 3278712 | agaV | b3133 |
| CDS | + | 3278723 | 3279124 | agaW | b3134 |
| CDS | + | 3279144 | 3279647 | agaA | b3135 |
| CDS | + | 3279998 | 3281152 | agaS | b3136 |
| CDS | + | 3281165 | 3282025 | agaY | b3137 |
| CDS | + | 3282192 | 3282668 | agaB | b3138 |
| CDS | + | 3282707 | 3283510 | agaC | b3139 |
| CDS | + | 3283500 | 3284291 | agaD | b3140 |
| CDS | + | 3284292 | 3285047 | agaI | b3141 |
| CDS | + | 3285448 | 3286032 | yraH | b3142 |
| CDS | + | 3286112 | 3286807 | yraI | b3143 |
| CDS | + | 3286836 | 3289352 | yraJ | b3144 |
| CDS | + | 3289369 | 3290454 | yraK | b3145 |
| CDS | − | 3290497 | 3291357 | yraL | b3146 |
| CDS | + | 3291422 | 3293458 | yraM | b3147 |
| CDS | + | 3293416 | 3293811 | yraN | b3148 |
| CDS | + | 3293831 | 3294421 | yraO | b3149 |
| CDS | + | 3294431 | 3295006 | yraP | b3150 |
| CDS | − | 3295120 | 3296160 | yraQ | b3151 |
| CDS | − | 3296233 | 3296868 | yraR | b3152 |
| CDS | + | 3296996 | 3297514 | yhbO | b3153 |
| CDS | + | 3297494 | 3297937 | yhbP | b3154 |
| CDS | + | 3297988 | 3298290 | yhbQ | b3155 |
| CDS | − | 3298277 | 3298780 | yhbS | b3156 |
| CDS | − | 3298774 | 3299298 | yhbT | b3157 |
| CDS | + | 3299507 | 3300502 | yhbU | b3158 |
| CDS | + | 3300511 | 3301389 | yhbV | b3159 |
| CDS | + | 3301470 | 3302477 | yhbW | b3160 |
| CDS | − | 3302595 | 3303839 | mtr | b3161 |
| CDS | − | 3303993 | 3305882 | deaD | b3162 |
| CDS | − | 3306062 | 3306946 | nlpI | b3163 |
| CDS | − | 3307055 | 3309259 | pnp | b3164 |
| CDS | − | 3309437 | 3309706 | rpsO | b3165 |
| CDS | − | 3309855 | 3310799 | truB | b3166 |
| CDS | − | 3310799 | 3311200 | rbfA | b3167 |
| CDS | − | 3311364 | 3314036 | infB | b3168 |
| CDS | − | 3314061 | 3315548 | nusA | b3169 |
| CDS | − | 3315576 | 3316028 | yhbC | b3170 |
| tRNA | − | 3316235 | 3316311 | metY | b3171 |
| CDS | + | 3316659 | 3318002 | argG | b3172 |
| CDS | − | 3318010 | 3319635 | yhbX | b3173 |
| tRNA | − | 3320094 | 3320180 | leuU | b3174 |
| CDS | − | 3320195 | 3320527 | secG | b3175 |
| CDS | − | 3320755 | 3322092 | glmM | b3176 |
| CDS | − | 3322085 | 3322933 | folP | b3177 |
| CDS | − | 3323023 | 3324957 | hflB | b3178 |
| CDS | − | 3325057 | 3325686 | rrmJ | b3179 |
| CDS | + | 3325812 | 3326105 | yhbY | b3180 |
| CDS | − | 3326261 | 3326737 | greA | b3181 |
| CDS | + | 3326985 | 3328418 | dacB | b3182 |
| CDS | − | 3328604 | 3329776 | yhbZ | b3183 |
| CDS | − | 3329792 | 3330757 | yhbE | b3184 |
| CDS | − | 3330884 | 3331141 | rpmA | b3185 |
| CDS | − | 3331162 | 3331473 | rplU | b3186 |
| CDS | + | 3331732 | 3332703 | ispB | b3187 |

TABLE 1-continued

| Type | S | Left | Right | Name | B |
|---|---|---|---|---|---|
| CDS | + | 3332931 | 3333209 | nlp | b3188 |
| CDS | − | 3333257 | 3334516 | murA | b3189 |
| CDS | − | 3334571 | 3334825 | yrbA | b3190 |
| CDS | − | 3334985 | 3335278 | yrbB | b3191 |
| CDS | − | 3335278 | 3335913 | yrbC | b3192 |
| CDS | − | 3335932 | 3336483 | yrbD | b3193 |
| CDS | − | 3336488 | 3337270 | yrbE | b3194 |
| CDS | − | 3337278 | 3338087 | yrbF | b3195 |
| CDS | + | 3338297 | 3339274 | yrbG | b3196 |
| CDS | + | 3339288 | 3340274 | yrbH | b3197 |
| CDS | + | 3340295 | 3340861 | yrbI | b3198 |
| CDS | + | 3340858 | 3341433 | yrbK | b3199 |
| CDS | + | 3341402 | 3341959 | yhbN | b3200 |
| CDS | + | 3341966 | 3342691 | yhbG | b3201 |
| CDS | + | 3342739 | 3344172 | rpoN | b3202 |
| CDS | + | 3344195 | 3344482 | yhbH | b3203 |
| CDS | + | 3344600 | 3345091 | ptsN | b3204 |
| CDS | + | 3345137 | 3345991 | yhbJ | b3205 |
| CDS | + | 3345988 | 3346260 | ptsO | b3206 |
| CDS | + | 3346474 | 3347106 | yrbL | b3207 |
| CDS | − | 3347103 | 3347831 | mtgA | b3208 |
| CDS | − | 3347828 | 3348481 | yhbL | b3209 |
| CDS | − | 3348711 | 3351047 | arcB | b3210 |
| CDS | − | 3351143 | 3352072 | yhcC | b3211 |
| CDS | + | 3352654 | 3357207 | gltB | b3212 |
| CDS | + | 3357220 | 3358638 | gltD | b3213 |
| CDS | + | 3359198 | 3359962 | gltF | b3214 |
| CDS | + | 3360134 | 3360808 | yhcA | b3215 |
| CDS | + | 3360829 | 3363210 | yhcD | b3216 |
| CDS | + | 3363207 | 3363686 | yhcE | b3217 |
| repeat_region | + | 3363578 | 3364772 |  |  |
| CDS | − | 3363724 | 3364740 | trs5_10 | b3218 |
| CDS | + | 3364948 | 3365664 | yhcF | b3219 |
| CDS | + | 3365849 | 3366976 | yhcG | b3220 |
| CDS | − | 3367036 | 3367500 | yhcH | b3221 |
| CDS | − | 3367497 | 3368372 | nanK | b3222 |
| CDS | − | 3368369 | 3369058 | nanE | b3223 |
| CDS | − | 3369106 | 3370596 | nanT | b3224 |
| CDS | − | 3370705 | 3371598 | nanA | b3225 |
| CDS | − | 3371720 | 3372511 | nanR | b3226 |
| CDS | + | 3372891 | 3374258 | dcuD | b3227 |
| CDS | − | 3374301 | 3374798 | sspB | b3228 |
| CDS | − | 3374804 | 3375442 | sspA | b3229 |
| CDS | − | 3375837 | 3376229 | rpsI | b3230 |
| CDS | − | 3376245 | 3376673 | rplM | b3231 |
| CDS | − | 3376892 | 3378019 | yhcM | b3232 |
| CDS | + | 3378213 | 3378611 | yhcB | b3233 |
| CDS | + | 3378765 | 3380132 | degQ | b3234 |
| CDS | + | 3380222 | 3381289 | degS | b3235 |
| CDS | − | 3381352 | 3382290 | mdh | b3236 |
| CDS | + | 3382725 | 3383195 | argR | b3237 |
| CDS | + | 3383560 | 3383823 | yhcN | b3238 |
| CDS | − | 3383879 | 3384151 | yhcO | b3239 |
| CDS | − | 3384243 | 3386210 | yhcP | b3240 |
| CDS | − | 3386216 | 3387148 | yhcQ | b3241 |
| CDS | − | 3387156 | 3387359 | yhcR | b3242 |
| CDS | + | 3387542 | 3388471 | yhcS | b3243 |
| CDS | − | 3388605 | 3390050 | tldD | b3244 |
| CDS | − | 3394348 | 3395817 | rng | b3247 |
| CDS | + | 3395807 | 3396400 | yhdE | b3248 |
| CDS | − | 3396409 | 3396897 | mreD | b3249 |
| CDS | − | 3396897 | 3398000 | mreC | b3250 |
| CDS | − | 3398066 | 3399109 | mreB | b3251 |
| CDS | − | 3399414 | 3401354 | yhdA | b3252 |
| CDS | + | 3401506 | 3402480 | yhdH | b3253 |
| CDS | − | 3402538 | 3402639 |  | b3254 |
| CDS | + | 3403458 | 3403928 | accB | b3255 |
| CDS | + | 3403939 | 3405288 | accC | b3256 |
| CDS | − | 3405397 | 3405639 | yhdT | b3257 |
| CDS | + | 3405629 | 3407080 | panF | b3258 |
| CDS | + | 3407092 | 3407973 | prmA | b3259 |
| CDS | + | 3408302 | 3409267 | yhdG | b3260 |
| CDS | + | 3409293 | 3409589 | fis | b3261 |
| CDS | + | 3409675 | 3410559 | yhdJ | b3262 |
| CDS | + | 3410643 | 3410822 | yhdU | b3263 |
| CDS | − | 3410825 | 3411487 | envR | b3264 |
| CDS | + | 3411886 | 3413043 | acrE | b3265 |
| CDS | + | 3413055 | 3416159 | acrF | b3266 |
| CDS | + | 3416412 | 3416633 | yhdV | b3267 |
| CDS | + | 3417171 | 3418088 | yhdW | b3268 |
| CDS | + | 3418156 | 3419337 | yhdX | b3269 |
| CDS | + | 3419347 | 3420450 | yhdY | b3270 |
| CDS | + | 3420458 | 3421216 | yhdZ | b3271 |
| rRNA | − | 3421445 | 3421564 | rrfF | b3272 |
| tRNA | − | 3421602 | 3421677 | thrV | b3273 |
| rRNA | − | 3421690 | 3421809 | rrfD | b3274 |
| rRNA | − | 3421902 | 3424805 | rrlD | b3275 |
| tRNA | − | 3424980 | 3425055 | alaU | b3276 |
| tRNA | − | 3425098 | 3425174 | ileU | b3277 |
| rRNA | − | 3425243 | 3426784 | rrsD | b3278 |
| CDS | + | 3427258 | 3427812 | yrdA | b3279 |
| CDS | − | 3427788 | 3428045 | yrdB | b3280 |
| CDS | − | 3428042 | 3428860 | aroE | b3281 |
| CDS | − | 3428865 | 3429437 | yrdC | b3282 |
| CDS | − | 3429442 | 3429984 | yrdD | b3283 |
| CDS | − | 3430013 | 3430486 | smg | b3284 |
| CDS | + | 3431712 | 3432221 | def | b3287 |
| CDS | + | 3432236 | 3433183 | fmt | b3288 |
| CDS | + | 3433229 | 3434518 | rrmB | b3289 |
| CDS | + | 3434540 | 3435916 | trkA | b3290 |
| CDS | + | 3436046 | 3436456 | mscL | b3291 |
| CDS | − | 3436727 | 3437152 | zntR | b3292 |
| CDS | − | 3437163 | 3437531 | yhdN | b3293 |
| CDS | − | 3437638 | 3438021 | rplQ | b3294 |
| CDS | − | 3438062 | 3439051 | rpoA | b3295 |
| CDS | − | 3439077 | 3439697 | rpsD | b3296 |
| CDS | − | 3439731 | 3440120 | rpsK | b3297 |
| CDS | − | 3440137 | 3440493 | rpsM | b3298 |
| CDS | − | 3440640 | 3440756 | rpmJ | b3299 |
| CDS | − | 3440788 | 3442119 | prlA | b3300 |
| CDS | − | 3442127 | 3442561 | rplO | b3301 |
| CDS | − | 3442565 | 3442744 | rpmD | b3302 |
| CDS | − | 3442748 | 3443251 | rpsE | b3303 |
| CDS | − | 3443266 | 3443619 | rplR | b3304 |
| CDS | − | 3443629 | 3444162 | rplF | b3305 |
| CDS | − | 3444175 | 3444567 | rpsH | b3306 |
| CDS | − | 3444601 | 3444906 | rpsN | b3307 |
| CDS | − | 3444921 | 3445460 | rplE | b3308 |
| CDS | − | 3445475 | 3445789 | rplX | b3309 |
| CDS | − | 3445800 | 3446171 | rplN | b3310 |
| CDS | − | 3446336 | 3446590 | rpsQ | b3311 |
| CDS | − | 3446590 | 3446781 | rpmC | b3312 |
| CDS | − | 3446781 | 3447191 | rplP | b3313 |
| CDS | − | 3447204 | 3447905 | rpsC | b3314 |
| CDS | − | 3447923 | 3448255 | rplV | b3315 |
| CDS | − | 3448270 | 3448548 | rpsS | b3316 |
| CDS | − | 3448565 | 3449386 | rplB | b3317 |
| CDS | − | 3449404 | 3449706 | rplW | b3318 |
| CDS | − | 3449703 | 3450308 | rplD | b3319 |
| CDS | − | 3450319 | 3450948 | rplC | b3320 |
| CDS | − | 3450981 | 3451292 | rpsJ | b3321 |
| CDS | + | 3451530 | 3451949 | pioO | b3322 |
| CDS | + | 3451951 | 3453420 | gspA | b3323 |
| CDS | + | 3453600 | 3454415 | gspC | b3324 |
| CDS | + | 3454399 | 3456351 | gspD | b3325 |
| CDS | + | 3456361 | 3457842 | gspE | b3326 |
| CDS | + | 3457839 | 3459035 | gspF | b3327 |
| CDS | + | 3459045 | 3459482 | gspG | b3328 |
| CDS | + | 3459490 | 3459999 | gspH | b3329 |
| CDS | + | 3459996 | 3460373 | gspI | b3330 |
| CDS | + | 3460366 | 3460953 | gspJ | b3331 |
| CDS | + | 3460946 | 3461929 | gspK | b3332 |
| CDS | + | 3461944 | 3463107 | gspL | b3333 |
| CDS | + | 3463104 | 3463565 | gspM | b3334 |
| CDS | + | 3463565 | 3464242 | gspO | b3335 |
| CDS | − | 3464271 | 3464747 | bfr | b3336 |
| CDS | − | 3464819 | 3465013 | bfd | b3337 |
| CDS | − | 3465182 | 3467875 | chiA | b3338 |
| CDS | − | 3468167 | 3469351 | tufA | b3339 |
| CDS | − | 3469422 | 3471536 | fusA | b3340 |
| CDS | − | 3471564 | 3472103 | rpsG | b3341 |
| CDS | − | 3472200 | 3472574 | rpsL | b3342 |
| CDS | − | 3472700 | 3472987 | yheL | b3343 |
| CDS | − | 3472995 | 3473354 | yheM | b3344 |
| CDS | − | 3473354 | 3473740 | yheN | b3345 |
| CDS | − | 3473740 | 3474462 | yheO | b3346 |

TABLE 1-continued

| Type | S | Left | Right | Name | B |
|---|---|---|---|---|---|
| CDS | − | 3474629 | 3475441 | fkpA | b3347 |
| CDS | + | 3475662 | 3475880 | slyX | b3348 |
| CDS | − | 3475929 | 3476519 | slyD | b3349 |
| CDS | − | 3476824 | 3478629 | kefB | b3350 |
| CDS | − | 3478629 | 3479183 | yheR | b3351 |
| CDS | + | 3479311 | 3481224 | yheS | b3352 |
| CDS | + | 3481224 | 3482246 | yheT | b3353 |
| CDS | + | 3482240 | 3482458 | yheU | b3354 |
| CDS | + | 3482512 | 3483381 | prkB | b3355 |
| CDS | − | 3483436 | 3483840 | yhfA | b3356 |
| CDS | + | 3484142 | 3484774 | crp | b3357 |
| CDS | + | 3484813 | 3486915 | yhfK | b3358 |
| CDS | − | 3486982 | 3488202 | argD | b3359 |
| CDS | − | 3488288 | 3488851 | pabA | b3360 |
| CDS | − | 3488883 | 3489485 | fic | b3361 |
| CDS | − | 3489475 | 3489642 | yhfG | b3362 |
| CDS | − | 3489747 | 3490319 | pplA | b3363 |
| CDS | + | 3490590 | 3491771 | yhfC | b3364 |
| CDS | + | 3492033 | 3494576 | nirB | b3365 |
| CDS | + | 3494573 | 3494899 | nirD | b3366 |
| CDS | + | 3495025 | 3495831 | nirC | b3367 |
| CDS | + | 3495850 | 3497223 | cysG | b3368 |
| CDS | + | 3497470 | 3497637 | yhfL | b3369 |
| CDS | + | 3497932 | 3499269 | yhfM | b3370 |
| CDS | + | 3499290 | 3500312 | yhfN | b3371 |
| CDS | + | 3501189 | 3501974 | yhfQ | b3374 |
| CDS | + | 3502074 | 3502805 | yhfR | b3375 |
| CDS | − | 3502957 | 3504042 | yhfS | b3376 |
| CDS | − | 3504054 | 3505358 | yhfT | b3377 |
| CDS | − | 3505370 | 3505723 | yhfU | b3378 |
| CDS | − | 3505734 | 3506612 | yhfV | b3379 |
| CDS | − | 3506609 | 3507835 | yhfW | b3380 |
| CDS | − | 3507835 | 3508998 | yhfX | b3381 |
| CDS | − | 3509082 | 3509444 | yhfY | b3382 |
| CDS | − | 3509461 | 3510366 | yhfZ | b3383 |
| CDS | − | 3510656 | 3511660 | trpS | b3384 |
| CDS | − | 3511653 | 3512411 | gph | b3385 |
| CDS | − | 3512404 | 3513081 | rpe | b3386 |
| CDS | − | 3513099 | 3513935 | dam | b3387 |
| CDS | − | 3514042 | 3515328 | damX | b3388 |
| CDS | − | 3515420 | 3516508 | aroB | b3389 |
| CDS | − | 3516565 | 3517086 | aroK | b3390 |
| CDS | − | 3517487 | 3518725 | hofQ | b3391 |
| CDS | − | 3518637 | 3519041 | yrfA | b3392 |
| CDS | − | 3519031 | 3519471 | yrfB | b3393 |
| CDS | − | 3519455 | 3519994 | yrfC | b3394 |
| CDS | − | 3519994 | 3520773 | yrfD | b3395 |
| CDS | + | 3520893 | 3523445 | mrcA | b3396 |
| CDS | − | 3523611 | 3524171 | yrfE | b3397 |
| CDS | + | 3524491 | 3526626 | yrfF | b3398 |
| CDS | + | 3526691 | 3527359 | yrfG | b3399 |
| CDS | + | 3527349 | 3527771 | hslR | b3400 |
| CDS | + | 3527796 | 3528674 | hslO | b3401 |
| CDS | − | 3528737 | 3530461 | yhgE | b3402 |
| CDS | + | 3530840 | 3532462 | pckA | b3403 |
| CDS | − | 3532538 | 3533890 | envZ | b3404 |
| CDS | − | 3533887 | 3534606 | ompR | b3405 |
| CDS | + | 3534834 | 3535310 | greB | b3406 |
| CDS | + | 3535407 | 3537728 | yhgF | b3407 |
| CDS | + | 3538185 | 3538412 | feoA | b3408 |
| CDS | + | 3538429 | 3540750 | feoB | b3409 |
| CDS | + | 3540750 | 3540986 | yhgG | b3410 |
| CDS | + | 3541189 | 3542067 | yhgA | b3411 |
| CDS | − | 3542096 | 3542866 | bioH | b3412 |
| CDS | + | 3542904 | 3543587 | yhgH | b3413 |
| CDS | + | 3543646 | 3544221 | yhgI | b3414 |
| CDS | + | 3544581 | 3545897 | gntT | b3415 |
| CDS | − | 3546008 | 3548092 | malQ | b3416 |
| CDS | − | 3548102 | 3550495 | malP | b3417 |
| CDS | + | 3551107 | 3553812 | malT | b3418 |
| CDS | − | 3554875 | 3556101 | rtcB | b3421 |
| CDS | + | 3556290 | 3557888 | rtcR | b3422 |
| CDS | − | 3557870 | 3558628 | glpR | b3423 |
| CDS | + | 3558645 | 3559475 | glpG | b3424 |
| CDS | + | 3559520 | 3559846 | glpE | b3425 |
| CDS | + | 3560036 | 3561541 | glpD | b3426 |
| CDS | − | 3561747 | 3562028 | yzgL | b3427 |
| CDS | − | 3562157 | 3564604 | glgP | b3428 |
| CDS | − | 3564623 | 3566056 | glgA | b3429 |
| CDS | − | 3566056 | 3567351 | glgC | b3430 |
| CDS | − | 3567369 | 3569342 | glgX | b3431 |
| CDS | − | 3569339 | 3571525 | glgB | b3432 |
| CDS | − | 3571798 | 3572901 | asd | b3433 |
| CDS | + | 3573094 | 3573687 | yhgN | b3434 |
| CDS | − | 3575088 | 3575615 | gntK | b3437 |
| CDS | − | 3575754 | 3576749 | gntR | b3438 |
| CDS | − | 3576973 | 3577668 | yhhW | b3439 |
| CDS | − | 3577791 | 3578828 | yhhX | b3440 |
| CDS | + | 3579161 | 3579649 | yhhY | b3441 |
| CDS | + | 3579886 | 3581064 | yhhZ | b3442 |
| CDS | + | 3581064 | 3581477 | yrhA | b3443 |
| repeat_region | + | 3581451 | 3582218 | | |
| CDS | + | 3581506 | 3581781 | insA_6 | b3444 |
| CDS | + | 3581700 | 3582203 | insB_6 | b3445 |
| CDS | + | 3582782 | 3583066 | yrhB | b3446 |
| CDS | − | 3583104 | 3584846 | ggt | b3447 |
| CDS | + | 3584966 | 3585406 | yhhA | b3448 |
| CDS | − | 3585393 | 3586136 | ugpQ | b3449 |
| CDS | − | 3586133 | 3587203 | ugpC | b3450 |
| CDS | − | 3587205 | 3588050 | ugpE | b3451 |
| CDS | − | 3588047 | 3588934 | ugpA | b3452 |
| CDS | − | 3589032 | 3590348 | ugpB | b3453 |
| CDS | − | 3590747 | 3591460 | livF | b3454 |
| CDS | − | 3591462 | 3592229 | livG | b3455 |
| CDS | − | 3592226 | 3593503 | livM | b3456 |
| CDS | − | 3593500 | 3594426 | livH | b3457 |
| CDS | − | 3594474 | 3595583 | livK | b3458 |
| CDS | + | 3596007 | 3596390 | yhhK | b3459 |
| CDS | − | 3596578 | 3597681 | livJ | b3460 |
| CDS | − | 3597952 | 3598806 | rpoH | b3461 |
| CDS | − | 3599051 | 3600109 | ftsX | b3462 |
| CDS | − | 3600102 | 3600770 | ftsE | b3463 |
| CDS | − | 3600773 | 3602266 | ftsY | b3464 |
| CDS | + | 3602416 | 3603012 | yhhF | b3465 |
| CDS | + | 3603002 | 3603271 | yhhL | b3466 |
| CDS | − | 3603274 | 3603633 | yhhM | b3467 |
| CDS | + | 3603774 | 3604400 | yhhN | b3468 |
| CDS | + | 3604474 | 3606672 | zntA | b3469 |
| CDS | − | 3606774 | 3607019 | sirA | b3470 |
| CDS | + | 3607240 | 3607905 | yhhQ | b3471 |
| CDS | + | 3607978 | 3608535 | dcrB | b3472 |
| CDS | − | 3608539 | 3609756 | yhhS | b3473 |
| CDS | + | 3609888 | 3610937 | yhhT | b3474 |
| CDS | + | 3610992 | 3611579 | acpT | b3475 |
| CDS | + | 3611690 | 3613264 | nikA | b3476 |
| CDS | + | 3613264 | 3614208 | nikB | b3477 |
| CDS | + | 3614205 | 3615038 | nikC | b3478 |
| CDS | + | 3615038 | 3615802 | nikD | b3479 |
| CDS | + | 3615799 | 3616605 | nikE | b3480 |
| CDS | + | 3616611 | 3617012 | nikR | b3481 |
| CDS | + | 3617215 | 3621450 | rhsB | b3482 |
| CDS | + | 3621422 | 3621805 | yhhH | b3483 |
| CDS | + | 3622401 | 3623537 | yhhI | b3484 |
| CDS | − | 3623702 | 3624826 | yhhJ | b3485 |
| CDS | − | 3624826 | 3627561 | yhiH | b3486 |
| CDS | − | 3627558 | 3628625 | yhiI | b3487 |
| CDS | − | 3628991 | 3630613 | yhiJ | b3488 |
| CDS | − | 3630875 | 3631267 | yhiK | b3489 |
| CDS | − | 3631243 | 3632481 | yhiL | b3490 |
| CDS | + | 3632864 | 3633916 | yhiM | b3491 |
| CDS | − | 3634231 | 3635433 | yhiN | b3492 |
| CDS | + | 3635665 | 3637164 | pitA | b3493 |
| CDS | − | 3637408 | 3637743 | yhiO | b3494 |
| CDS | + | 3638134 | 3638568 | uspA | b3495 |
| CDS | + | 3638885 | 3640354 | yhiP | b3496 |
| CDS | − | 3640403 | 3641156 | yhiQ | b3497 |
| CDS | − | 3641163 | 3643205 | prlC | b3498 |
| CDS | + | 3643408 | 3644250 | yhiR | b3499 |
| CDS | − | 3644322 | 3645674 | gor | b3500 |
| CDS | + | 3646551 | 3646904 | arsR | b3501 |
| CDS | + | 3646958 | 3648247 | arsB | b3502 |
| CDS | + | 3648260 | 3648685 | arsC | b3503 |
| CDS | + | 3649314 | 3650096 | yhiS | b3504 |
| repeat_region | + | 3650059 | 3651253 | | |
| CDS | − | 3650205 | 3651221 | trs5_11 | b3505 |
| CDS | + | 3651984 | 3652550 | slp | b3506 |

TABLE 1-continued

| Type | S | Left | Right | Name | B |
|---|---|---|---|---|---|
| CDS | + | 3652706 | 3653236 | yhiF | b3507 |
| CDS | − | 3653278 | 3653925 | yhiD | b3508 |
| CDS | − | 3653989 | 3654315 | hdeB | b3509 |
| CDS | − | 3654431 | 3654763 | hdeA | b3510 |
| CDS | + | 3655018 | 3655590 | hdeD | b3511 |
| CDS | + | 3656389 | 3656916 | yhiE | b3512 |
| CDS | + | 3657255 | 3658412 | yhiU | b3513 |
| CDS | + | 3658437 | 3661550 | yhiV | b3514 |
| CDS | − | 3661913 | 3662641 | yhiW | b3515 |
| CDS | − | 3663009 | 3663833 | gadX | b3516 |
| CDS | − | 3664203 | 3665603 | gadA | b3517 |
| CDS | − | 3665814 | 3667211 | yhjA | b3518 |
| CDS | + | 3667615 | 3669264 | treF | b3519 |
| CDS | − | 3669315 | 3669917 | yhjB | b3520 |
| CDS | + | 3670365 | 3671336 | yhjC | b3521 |
| CDS | + | 3671385 | 3672398 | yhjD | b3522 |
| CDS | + | 3672809 | 3674131 | yhjE | b3523 |
| CDS | − | 3674313 | 3676388 | yhjG | b3524 |
| CDS | − | 3676443 | 3677210 | yhjH | b3525 |
| CDS | + | 3677442 | 3678371 | kdgK | b3526 |
| CDS | − | 3678467 | 3679963 | yhjJ | b3527 |
| CDS | − | 3680184 | 3681470 | dctA | b3528 |
| CDS | − | 3681653 | 3683602 | yhjk | b3529 |
| CDS | − | 3683723 | 3687196 | yhiL | b3530 |
| CDS | − | 3687178 | 3688284 | bcsC | b3531 |
| CDS | − | 3688291 | 3690630 | yhjN | b3532 |
| CDS | − | 3690641 | 3693259 | yhjO | b3533 |
| CDS | − | 3693256 | 3693984 | yhjQ | b3534 |
| CDS | − | 3694020 | 3694208 | yhjR | b3535 |
| CDS | + | 3694481 | 3696052 | yhiS | b3536 |
| CDS | + | 3696049 | 3696240 | yhiT | b3537 |
| CDS | + | 3696237 | 3697916 | yhjU | b3538 |
| CDS | + | 3698586 | 3699857 | yhjV | b3539 |
| CDS | − | 3699887 | 3700891 | dppF | b3540 |
| CDS | − | 3700888 | 3701871 | dppD | b3541 |
| CDS | − | 3701882 | 3702784 | dppC | b3542 |
| CDS | − | 3702794 | 3703813 | dppB | b3543 |
| CDS | − | 3704121 | 3705728 | dppA | b3544 |
| tRNA | − | 3706639 | 3706715 | proK | b3545 |
| CDS | − | 3706807 | 3708498 | yhjW | b3546 |
| CDS | − | 3708822 | 3710030 | yhjX | b3547 |
| CDS | − | 3710259 | 3710957 | yhjY | b3548 |
| CDS | + | 3711115 | 3711678 | tag | b3549 |
| CDS | + | 3711675 | 3712115 | yiaC | b3550 |
| CDS | − | 3712084 | 3714363 | bisC | b3551 |
| CDS | + | 3714570 | 3715229 | yiaD | b3552 |
| CDS | + | 3715333 | 3716307 | tkrA | b3553 |
| CDS | − | 3716357 | 3717067 | yiaF | b3554 |
| CDS | + | 3717501 | 3717791 | yiaG | b3555 |
| CDS | + | 3718072 | 3718284 | cspA | b3556 |
| repeat_region | + | 3718656 | 3720098 | | |
| CDS | + | 3718703 | 3719224 | yi5A | b3557 |
| CDS | + | 3719221 | 3720072 | t150 | b3558 |
| CDS | − | 3720351 | 3722420 | glyS | b3559 |
| CDS | − | 3722430 | 3723341 | glyQ | b3560 |
| CDS | − | 3723910 | 3724905 | yiaH | b3561 |
| CDS | − | 3724947 | 3725384 | yiaA | b3562 |
| CDS | − | 3725430 | 3725771 | yiaB | b3563 |
| CDS | − | 3725940 | 3727394 | xylB | b3564 |
| CDS | − | 3727466 | 3728788 | xylA | b3565 |
| CDS | + | 3729154 | 3730146 | xylF | b3566 |
| CDS | + | 3730224 | 3731765 | xylG | b3567 |
| CDS | + | 3731743 | 3732924 | xylH | b3568 |
| CDS | + | 3733002 | 3734180 | xylR | b3569 |
| CDS | − | 3734376 | 3735200 | bax | b3570 |
| CDS | + | 3735520 | 3737550 | malS | b3571 |
| CDS | + | 3737728 | 3738981 | avtA | b3572 |
| CDS | − | 3739132 | 3739605 | yiaI | b3573 |
| CDS | − | 3739707 | 3740555 | yiaJ | b3574 |
| CDS | + | 3740756 | 3741754 | yiaK | b3575 |
| CDS | + | 3741766 | 3742233 | yiaL | b3576 |
| CDS | + | 3742351 | 3742824 | yiaM | b3577 |
| CDS | + | 3742827 | 3744104 | yiaN | b3578 |
| CDS | + | 3744117 | 3745103 | yiaO | b3579 |
| CDS | + | 3745107 | 3746603 | lyxK | b3580 |
| CDS | + | 3746600 | 3747262 | sgbH | b3581 |
| CDS | + | 3747255 | 3748115 | sgbU | b3582 |
| CDS | + | 3748109 | 3748804 | sgbE | b3583 |
| CDS | − | 3749151 | 3749891 | yiaT | b3584 |
| CDS | + | 3750015 | 3750989 | yiaU | b3585 |
| CDS | − | 3750986 | 3752122 | yiaV | b3586 |
| CDS | − | 3752128 | 3752451 | yiaW | b3587 |
| CDS | − | 3752996 | 3754534 | aldB | b3588 |
| CDS | − | 3754699 | 3755850 | yiaY | b3589 |
| CDS | − | 3756040 | 3757884 | selB | b3590 |
| CDS | − | 3757881 | 3759272 | selA | b3591 |
| CDS | − | 3759370 | 3759978 | yibF | b3592 |
| CDS | + | 3760206 | 3764339 | rhsA | b3593 |
| CDS | + | 3764360 | 3765202 | yibA | b3594 |
| CDS | + | 3765244 | 3765945 | yibJ | b3595 |
| CDS | + | 3766200 | 3766661 | yibG | b3596 |
| CDS | − | 3768266 | 3769402 | yibH | b3597 |
| CDS | − | 3769405 | 3769767 | yibI | b3598 |
| CDS | + | 3770304 | 3772217 | mtlA | b3599 |
| CDS | + | 3772447 | 3773595 | mtlD | b3600 |
| CDS | + | 3773595 | 3774182 | mtlR | b3601 |
| CDS | + | 3774688 | 3775050 | yibL | b3602 |
| CDS | + | 3775422 | 3777077 | lldP | b3603 |
| CDS | + | 3777077 | 3777853 | lldR | b3604 |
| CDS | + | 3777850 | 3779040 | lldD | b3605 |
| CDS | + | 3779238 | 3779711 | yibK | b3606 |
| CDS | − | 3779764 | 3780585 | cysE | b3607 |
| CDS | − | 3780665 | 3781684 | gpsA | b3608 |
| CDS | − | 3781684 | 3782151 | secB | b3609 |
| CDS | − | 3782214 | 3782465 | grxC | b3610 |
| CDS | − | 3782607 | 3783038 | yibN | b3611 |
| CDS | + | 3783283 | 3784827 | yibO | b3612 |
| CDS | + | 3784861 | 3786120 | yibP | b3613 |
| CDS | + | 3786124 | 3787083 | yibQ | b3614 |
| CDS | − | 3787070 | 3788104 | yibD | b3615 |
| CDS | − | 3788343 | 3789368 | tdh | b3616 |
| CDS | − | 3789378 | 3790574 | kbl | b3617 |
| CDS | − | 3790849 | 3791706 | htrL | b3618 |
| CDS | + | 3792010 | 3792942 | rfaD | b3619 |
| CDS | + | 3792952 | 3793998 | rfaF | b3620 |
| CDS | + | 3794002 | 3794961 | rfaC | b3621 |
| CDS | + | 3794971 | 3796230 | rfaL | b3622 |
| CDS | − | 3796262 | 3797335 | rfaK | b3623 |
| CDS | − | 3797368 | 3798219 | rfaZ | b3624 |
| CDS | − | 3798290 | 3798988 | rfaY | b3625 |
| CDS | − | 3799006 | 3800022 | rfaJ | b3626 |
| CDS | − | 3800062 | 3801081 | rfaI | b3627 |
| CDS | − | 3801081 | 3802190 | rfaB | b3628 |
| CDS | − | 3802204 | 3803139 | rfaS | b3629 |
| CDS | − | 3803176 | 3803973 | rfaP | b3630 |
| CDS | − | 3803966 | 3805090 | rfaG | b3631 |
| CDS | − | 3805087 | 3806121 | rfaQ | b3632 |
| CDS | + | 3806563 | 3807840 | kdtA | b3633 |
| CDS | + | 3807848 | 3808327 | coaD | b3634 |
| CDS | − | 3808366 | 3809175 | mutM | b3635 |
| CDS | − | 3809273 | 3809440 | rpmG | b3636 |
| CDS | − | 3809461 | 3809697 | rpmB | b3637 |
| CDS | − | 3809914 | 3810582 | radC | b3638 |
| CDS | + | 3810754 | 3811974 | dfp | b3639 |
| CDS | + | 3811955 | 3812410 | dut | b3640 |
| CDS | + | 3812517 | 3813113 | ttk | b3641 |
| CDS | − | 3813150 | 3813791 | pyrE | b3642 |
| CDS | − | 3813886 | 3814572 | rph | b3643 |
| CDS | + | 3814699 | 3815562 | yicC | b3644 |
| CDS | + | 3815783 | 3816607 | dinD | b3645 |
| CDS | + | 3816897 | 3817514 | yicG | b3646 |
| CDS | − | 3817511 | 3819193 | yicF | b3647 |
| CDS | + | 3819451 | 3820074 | gmk | b3648 |
| CDS | + | 3820129 | 3820404 | rpoZ | b3649 |
| CDS | + | 3820423 | 3822531 | spoT | b3650 |
| CDS | + | 3822538 | 3823227 | trmH | b3651 |
| CDS | + | 3823233 | 3825314 | recG | b3652 |
| CDS | − | 3825483 | 3826688 | gltS | b3653 |
| CDS | + | 3826968 | 3828359 | yicE | b3654 |
| CDS | + | 3828480 | 3830189 | yicH | b3655 |
| CDS | − | 3830242 | 3832560 | yicI | b3656 |
| CDS | − | 3832570 | 3833952 | yicJ | b3657 |
| tRNA | + | 3834245 | 3834339 | selC | b3658 |
| CDS | + | 3834976 | 3836160 | yicK | b3659 |
| CDS | + | 3836271 | 3837194 | yicL | b3660 |
| CDS | − | 3837198 | 3838016 | nlpA | b3661 |

TABLE 1-continued

| Type | S | Left | Right | Name | B |
|---|---|---|---|---|---|
| CDS | − | 3838572 | 3839927 | yicM | b3662 |
| CDS | − | 3839973 | 3840425 | yicN | b3663 |
| CDS | − | 3840478 | 3841812 | yicO | b3664 |
| CDS | + | 3841987 | 3843753 | ade | b3665 |
| CDS | − | 3843799 | 3845190 | uhpT | b3666 |
| CDS | − | 3845328 | 3846647 | uhpC | b3667 |
| CDS | − | 3846657 | 3848159 | uhpB | b3668 |
| CDS | − | 3848159 | 3848749 | uhpA | b3669 |
| CDS | − | 3848825 | 3849115 | ilvN | b3670 |
| CDS | − | 3849119 | 3850807 | ilvB | b3671 |
| CDS | − | 3850913 | 3851011 | ivbL | b3672 |
| CDS | + | 3851945 | 3853129 | emrD | b3673 |
| CDS | − | 3853137 | 3853634 | yidE | b3674 |
| CDS | − | 3853631 | 3853993 | yidG | b3675 |
| CDS | − | 3853983 | 3854330 | yidH | b3676 |
| CDS | + | 3854438 | 3854887 | yidI | b3677 |
| CDS | − | 3854934 | 3856427 | yidJ | b3678 |
| CDS | − | 3856424 | 3858139 | yidK | b3679 |
| CDS | + | 3858276 | 3859199 | yidL | b3680 |
| CDS | − | 3859372 | 3860010 | glvG | b3681 |
| CDS | − | 3860010 | 3860495 | glvB | b3682 |
| CDS | − | 3860520 | 3861626 | glvC | b3683 |
| CDS | + | 3861922 | 3862638 | yidP | b3684 |
| CDS | − | 3862635 | 3864296 | yidE | b3685 |
| CDS | − | 3864492 | 3864920 | ibpB | b3686 |
| CDS | − | 3865032 | 3865445 | ibpA | b3687 |
| CDS | + | 3865751 | 3866083 | yidQ | b3688 |
| CDS | − | 3866085 | 3867299 | yidR | b3689 |
| CDS | + | 3867400 | 3868464 | yidS | b3690 |
| CDS | − | 3868461 | 3869753 | dgoT | b3691 |
| CDS | − | 3871619 | 3872497 | dgoK | b3693 |
| CDS | + | 3873461 | 3874117 | yidX | b3696 |
| CDS | − | 3874163 | 3874975 | yidA | b3697 |
| CDS | − | 3875090 | 3875488 | yidB | b3698 |
| CDS | − | 3875728 | 3878142 | gyrB | b3699 |
| CDS | − | 3878171 | 3879244 | recF | b3700 |
| CDS | − | 3879244 | 3880344 | dnaN | b3701 |
| CDS | − | 3880349 | 3881752 | dnaA | b3702 |
| CDS | + | 3882359 | 3882499 | rpmH | b3703 |
| CDS | + | 3882516 | 3882875 | rnpA | b3704 |
| CDS | + | 3883099 | 3884745 | yidC | b3705 |
| CDS | + | 3884851 | 3886215 | trmE | b3706 |
| CDS | + | 3886458 | 3886532 | tnaL | b3707 |
| CDS | + | 3886753 | 3888168 | tnaA | b3708 |
| CDS | + | 3888259 | 3889506 | tnaB | b3709 |
| CDS | + | 3889638 | 3890813 | yidY | b3710 |
| CDS | + | 3890788 | 3891747 | yidZ | b3711 |
| CDS | + | 3891892 | 3892653 | yieF | b3712 |
| CDS | + | 3892675 | 3893241 | yieF | b3713 |
| CDS | − | 3893295 | 3894632 | yieG | b3714 |
| CDS | + | 3894797 | 3895462 | yieH | b3715 |
| CDS | + | 3895529 | 3895996 | yieI | b3716 |
| CDS | + | 3896045 | 3896632 | yieJ | b3717 |
| CDS | − | 3896694 | 3897416 | yieK | b3718 |
| CDS | − | 3897431 | 3898627 | yieL | b3719 |
| CDS | − | 3898627 | 3900243 | yieC | b3720 |
| CDS | − | 3900312 | 3901724 | bglB | b3721 |
| CDS | − | 3901743 | 3903620 | bglF | b3722 |
| CDS | − | 3903754 | 3904590 | bglG | b3723 |
| CDS | − | 3904876 | 3905601 | phoU | b3724 |
| CDS | − | 3905616 | 3906389 | pstB | b3725 |
| CDS | − | 3906572 | 3907462 | pstA | b3726 |
| CDS | − | 3907462 | 3908421 | pstC | b3727 |
| CDS | − | 3908508 | 3909548 | pstS | b3728 |
| CDS | − | 3909862 | 3911691 | glmS | b3729 |
| CDS | − | 3911853 | 3913223 | glmU | b3730 |
| CDS | − | 3913576 | 3913995 | atpC | b3731 |
| CDS | − | 3914016 | 3915398 | atpD | b3732 |
| CDS | − | 3915425 | 3916288 | atpG | b3733 |
| CDS | − | 3916339 | 3917880 | atpA | b3734 |
| CDS | − | 3917893 | 3918426 | atpH | b3735 |
| CDS | − | 3918441 | 3918911 | atpF | b3736 |
| CDS | − | 3918973 | 3919212 | atpE | b3737 |
| CDS | − | 3919259 | 3920074 | atpB | b3738 |
| CDS | − | 3920083 | 3920463 | atpI | b3739 |
| CDS | − | 3921080 | 3921703 | gidB | b3740 |
| CDS | − | 3921767 | 3923656 | gidA | b3741 |
| rep_origin | + | 3923767 | 3923998 | | b4489 |
| CDS | − | 3924035 | 3924478 | mioC | b3742 |
| CDS | − | 3924568 | 3925026 | asnC | b3743 |
| CDS | + | 3925178 | 3926170 | asnA | b3744 |
| CDS | + | 3926175 | 3927626 | yieM | b3745 |
| CDS | − | 3927620 | 3929116 | yieN | b3746 |
| CDS | + | 3929339 | 3931207 | kup | b3747 |
| CDS | + | 3931374 | 3931793 | rbsD | b3748 |
| CDS | + | 3931801 | 3933306 | rbsA | b3749 |
| CDS | + | 3933311 | 3934276 | rbsC | b3750 |
| CDS | + | 3934301 | 3935191 | rbsB | b3751 |
| CDS | + | 3935317 | 3936246 | rbsK | b3752 |
| CDS | + | 3936250 | 3937242 | rbsR | b3753 |
| CDS | − | 3937208 | 3938635 | yieO | b3754 |
| CDS | − | 3938658 | 3939350 | yieP | b3755 |
| rRNA | + | 3939831 | 3941372 | rrsC | b3756 |
| tRNA | + | 3941458 | 3941533 | gltU | b3757 |
| rRNA | + | 3941727 | 3944630 | rrlC | b3758 |
| rRNA | + | 3944723 | 3944842 | rrfC | b3759 |
| tRNA | + | 3944895 | 3944971 | aspT | b3760 |
| tRNA | + | 3944980 | 3945055 | trpT | b3761 |
| CDS | + | 3946109 | 3946447 | yifE | b3764 |
| CDS | − | 3946472 | 3948022 | yifB | b3765 |
| CDS | + | 3948345 | 3948443 | ilvL | b3766 |
| CDS | + | 3948583 | 3949566 | ilvG_1 | b3767 |
| CDS | + | 3949646 | 3950227 | ilvG_2 | b3768 |
| CDS | + | 3950224 | 3950487 | ilvM | b3769 |
| CDS | + | 3950507 | 3951436 | ilvE | b3770 |
| CDS | + | 3951501 | 3953351 | ilvD | b3771 |
| CDS | + | 3953354 | 3954898 | ilvA | b3772 |
| CDS | − | 3954950 | 3955843 | ilvY | b3773 |
| CDS | + | 3955993 | 3957468 | ilvC | b3774 |
| CDS | − | 3957555 | 3957836 | ppiC | b3775 |
| CDS | − | 3958035 | 3958310 | | b3776 |
| CDS | − | 3958265 | 3958483 | yifN | b3777 |
| CDS | + | 3958700 | 3960721 | rep | b3778 |
| CDS | − | 3960768 | 3962252 | gppA | b3779 |
| CDS | − | 3962388 | 3963653 | rhlB | b3780 |
| CDS | + | 3963784 | 3964113 | trxA | b3781 |
| CDS | + | 3964254 | 3964355 | rhoL | b3782 |
| CDS | + | 3964440 | 3965699 | rho | b3783 |
| CDS | + | 3965939 | 3967042 | rfe | b3784 |
| CDS | + | 3967054 | 3968100 | wzzE | b3785 |
| CDS | + | 3968156 | 3969286 | wecB | b3786 |
| CDS | + | 3969283 | 3970545 | wecC | b3787 |
| CDS | + | 3970545 | 3971612 | rffG | b3788 |
| CDS | + | 3971631 | 3972512 | rffH | b3789 |
| CDS | + | 3972619 | 3973164 | wecD | b3790 |
| CDS | + | 3973169 | 3974299 | wecE | b3791 |
| CDS | + | 3974301 | 3975551 | wzxE | b3792 |
| CDS | + | 3976624 | 3977976 | wzyE | b3793 |
| CDS | + | 3977979 | 3978719 | wecG | b3794 |
| CDS | + | 3978710 | 3980295 | yifK | b3795 |
| tRNA | + | 3980398 | 3980474 | argX | b3796 |
| tRNA | + | 3980532 | 3980608 | hisR | b3797 |
| tRNA | + | 3980629 | 3980715 | leuT | b3798 |
| tRNA | + | 3980758 | 3980834 | proM | b3799 |
| CDS | + | 3980981 | 3982216 | aslB | b3800 |
| CDS | + | 3982375 | 3984030 | aslA | b3801 |
| CDS | − | 3984709 | 3985905 | hemY | b3802 |
| CDS | − | 3985908 | 3987089 | hemX | b3803 |
| CDS | − | 3987111 | 3987851 | hemD | b3804 |
| CDS | − | 3987848 | 3988789 | hemC | b3805 |
| CDS | + | 3989176 | 3991722 | cyaA | b3806 |
| CDS | − | 3991762 | 3992082 | cyaY | b3807 |
| CDS | + | 3991873 | 3992358 | yzcX | b3808 |
| CDS | + | 3992785 | 3993609 | dapF | b3809 |
| CDS | + | 3993606 | 3994313 | yigA | b3810 |
| CDS | + | 3994310 | 3995206 | xerC | b3811 |
| CDS | + | 3995206 | 3995922 | yigB | b3812 |
| CDS | + | 3996006 | 3998168 | uvrD | b3813 |
| CDS | + | 3999449 | 4000399 | corA | b3816 |
| CDS | − | 4000442 | 4000822 | yigF | b3817 |
| CDS | − | 4000836 | 4001216 | yigG | b3818 |
| CDS | − | 4001311 | 4002201 | rarD | b3819 |
| CDS | − | 4002253 | 4002720 | yigI | b3820 |
| CDS | + | 4002885 | 4003754 | pldA | b3821 |
| CDS | + | 4003887 | 4005716 | recQ | b3822 |
| CDS | + | 4005780 | 4006400 | rhtC | b3823 |

TABLE 1-continued

| Type | S | Left | Right | Name | B |
|---|---|---|---|---|---|
| CDS | − | 4006462 | 4007082 | rhtB | b3824 |
| CDS | + | 4007193 | 4008215 | pldB | b3825 |
| CDS | + | 4008223 | 4009023 | yigL | b3826 |
| CDS | + | 4009099 | 4009998 | yigM | b3827 |
| CDS | − | 4009886 | 4010839 | metR | b3828 |
| CDS | + | 4011076 | 4013337 | metE | b3829 |
| CDS | − | 4013377 | 4014192 | ysgA | b3830 |
| CDS | + | 4014454 | 4015215 | udp | b3831 |
| CDS | + | 4015356 | 4016783 | yigN | b3832 |
| CDS | + | 4016878 | 4017633 | ubiE | b3833 |
| CDS | + | 4017647 | 4018252 | yigP | b3834 |
| CDS | + | 4018249 | 4019889 | ubiB | b3835 |
| CDS | + | 4019968 | 4020237 | tatA | b3836 |
| CDS | + | 4020241 | 4020756 | tatB | b3838 |
| CDS | + | 4020759 | 4021535 | tatC | b3839 |
| CDS | − | 4022356 | 4022844 | rfaH | b3842 |
| CDS | + | 4023011 | 4024504 | ubiD | b3843 |
| CDS | + | 4024550 | 4025251 | fre | b3844 |
| CDS | − | 4025632 | 4026795 | fadA | b3845 |
| CDS | − | 4026805 | 4028994 | fadB | b3846 |
| CDS | + | 4029184 | 4030515 | pepQ | b3847 |
| CDS | + | 4030515 | 4031129 | yigZ | b3848 |
| CDS | + | 4031168 | 4032619 | trkH | b3849 |
| CDS | + | 4032631 | 4033176 | hemG | b3850 |
| rRNA | + | 4033554 | 4035095 | rrsA | b3851 |
| tRNA | + | 4035164 | 4035240 | ileT | b3852 |
| tRNA | + | 4035283 | 4035358 | alaT | b3853 |
| rRNA | + | 4035542 | 4038446 | rrlA | b3854 |
| rRNA | + | 4038540 | 4038659 | rrfA | b3855 |
| CDS | − | 4038929 | 4039441 | mobB | b3856 |
| CDS | − | 4039438 | 4040022 | mobA | b3857 |
| CDS | + | 4040092 | 4040361 | yihD | b3858 |
| CDS | + | 4040438 | 4041424 | yihE | b3859 |
| CDS | + | 4041441 | 4042067 | dsbA | b3860 |
| CDS | + | 4042222 | 4043652 | yihF | b3861 |
| CDS | − | 4043693 | 4044625 | yihG | b3862 |
| CDS | + | 4044989 | 4047775 | polA | b3863 |
| misc_RNA | + | 4047922 | 4048030 | spf | b3864 |
| CDS | − | 4048156 | 4048752 | yihA | b3865 |
| CDS | + | 4049370 | 4049879 | yihI | b3866 |
| CDS | + | 4050068 | 4051441 | hemN | b3867 |
| CDS | − | 4051892 | 4053301 | glnG | b3868 |
| CDS | − | 4053313 | 4054362 | glnL | b3869 |
| CDS | − | 4054648 | 4056057 | glnA | b3870 |
| CDS | + | 4056430 | 4058253 | bipA | b3871 |
| CDS | + | 4058470 | 4059180 | yihL | b3872 |
| CDS | + | 4059188 | 4060168 | yihM | b3873 |
| CDS | + | 4060270 | 4061535 | yihN | b3874 |
| CDS | + | 4061626 | 4062318 | yshA | b3875 |
| CDS | − | 4062386 | 4063789 | yihO | b3876 |
| CDS | − | 4063832 | 4065238 | yihP | b3877 |
| CDS | − | 4065263 | 4067299 | yihQ | b3878 |
| CDS | − | 4067498 | 4068424 | yihR | b3879 |
| CDS | − | 4068538 | 4069779 | yihS | b3880 |
| CDS | − | 4069796 | 4070674 | yihT | b3881 |
| CDS | − | 4070698 | 4071594 | yihU | b3882 |
| CDS | + | 4071762 | 4072658 | yihV | b3883 |
| CDS | + | 4072692 | 4073477 | yihW | b3884 |
| CDS | + | 4073576 | 4074175 | yihX | b3885 |
| CDS | + | 4074169 | 4075041 | rbn | b3886 |
| CDS | + | 4075038 | 4075475 | dtd | b3887 |
| CDS | + | 4075472 | 4076461 | yiiD | b3888 |
| CDS | + | 4077314 | 4077532 | yiiE | b3889 |
| CDS | + | 4077774 | 4077992 | yiiF | b3890 |
| CDS | − | 4078322 | 4079251 | fdhE | b3891 |
| CDS | − | 4079248 | 4079883 | fdoI | b3892 |
| CDS | − | 4079880 | 4080782 | fdoH | b3893 |
| CDS | − | 4080795 | 4083845 | fdoG | b3894 |
| CDS | + | 4084039 | 4084872 | fdhD | b3895 |
| CDS | + | 4085025 | 4086080 | yiiG | b3896 |
| CDS | − | 4086130 | 4087878 | frvR | b3897 |
| CDS | − | 4087878 | 4088948 | frvX | b3898 |
| CDS | − | 4088938 | 4090389 | frvB | b3899 |
| CDS | − | 4090400 | 4090846 | frvA | b3900 |
| CDS | + | 4091147 | 4091461 | yiiL | b3901 |
| CDS | − | 4091471 | 4092295 | rhaD | b3902 |
| CDS | − | 4092746 | 4094005 | rhaA | b3903 |
| CDS | − | 4094002 | 4095471 | rhaB | b3904 |
| CDS | + | 4095759 | 4096595 | rhaS | b3905 |
| CDS | + | 4096579 | 4097517 | rhaR | b3906 |
| CDS | − | 4097514 | 4098548 | rhaT | b3907 |
| CDS | + | 4098833 | 4099453 | sodA | b3908 |
| CDS | + | 4099713 | 4100696 | kdgT | b3909 |
| CDS | + | 4100845 | 4101519 | yiiO | b3910 |
| CDS | − | 4101625 | 4102998 | cpxA | b3911 |
| CDS | − | 4102995 | 4103693 | cpxR | b3912 |
| CDS | + | 4104492 | 4105394 | yiiP | b3915 |
| CDS | + | 4105575 | 4106537 | pfkA | b3916 |
| CDS | + | 4106857 | 4107846 | sbp | b3917 |
| CDS | + | 4107953 | 4108708 | cdh | b3918 |
| CDS | − | 4108763 | 4109530 | tpiA | b3919 |
| CDS | − | 4109638 | 4110237 | yiiQ | b3920 |
| CDS | + | 4110338 | 4110778 | yiiR | b3921 |
| CDS | + | 4110990 | 4111289 | yiiS | b3922 |
| CDS | + | 4111316 | 4111744 | yiiT | b3923 |
| CDS | − | 4111749 | 4112495 | fpr | b3924 |
| CDS | − | 4112592 | 4113602 | glpX | b3925 |
| CDS | − | 4113737 | 4115245 | glpK | b3926 |
| CDS | − | 4115268 | 4116113 | glpE | b3927 |
| CDS | + | 4116538 | 4116783 | yiiU | b3928 |
| CDS | − | 4116868 | 4117353 | menG | b3929 |
| CDS | − | 4117446 | 4118372 | menA | b3930 |
| CDS | − | 4118439 | 4119770 | hslU | b3931 |
| CDS | − | 4119780 | 4120310 | hslV | b3932 |
| CDS | − | 4120403 | 4121362 | ftsN | b3933 |
| CDS | − | 4121454 | 4122479 | cytR | b3934 |
| CDS | − | 4122635 | 4124833 | priA | b3935 |
| CDS | + | 4125036 | 4125248 | rpmE | b3936 |
| CDS | − | 4125309 | 4125917 | yiiX | b3937 |
| CDS | − | 4126101 | 4126418 | metJ | b3938 |
| CDS | + | 4126695 | 4127855 | metB | b3939 |
| CDS | + | 4127858 | 4130290 | metL | b3940 |
| CDS | + | 4130639 | 4131529 | metF | b3941 |
| CDS | + | 4131858 | 4134038 | katG | b3942 |
| CDS | + | 4134131 | 4135036 | yijE | b3943 |
| CDS | − | 4135063 | 4135680 | yijF | b3944 |
| CDS | − | 4135955 | 4137058 | gldA | b3945 |
| CDS | − | 4137069 | 4137731 | talC | b3946 |
| CDS | − | 4137743 | 4140244 | ptsA | b3947 |
| CDS | + | 4140553 | 4141632 | frwC | b3949 |
| CDS | + | 4141647 | 4141967 | frwB | b3950 |
| CDS | + | 4142018 | 4144315 | pflD | b3951 |
| CDS | + | 4144281 | 4145159 | pflC | b3952 |
| CDS | + | 4145161 | 4145502 | frwD | b3953 |
| CDS | − | 4145489 | 4146340 | yijO | b3954 |
| CDS | − | 4146555 | 4148288 | yijP | b3955 |
| CDS | − | 4148470 | 4151121 | ppc | b3956 |
| CDS | − | 4151719 | 4152870 | argE | b3957 |
| CDS | + | 4153024 | 4154028 | argC | b3958 |
| CDS | + | 4154039 | 4154812 | argB | b3959 |
| CDS | + | 4154873 | 4156246 | argH | b3960 |
| CDS | + | 4156513 | 4157430 | oxyR | b3961 |
| CDS | − | 4157413 | 4158813 | udhA | b3962 |
| CDS | + | 4159090 | 4159794 | yijC | b3963 |
| CDS | + | 4159794 | 4160153 | yijD | b3964 |
| CDS | − | 4160193 | 4161293 | trmA | b3965 |
| CDS | + | 4161662 | 4163506 | btuB | b3966 |
| CDS | + | 4163451 | 4164308 | murI | b3967 |
| rRNA | + | 4164682 | 4166223 | rrsB | b3968 |
| tRNA | + | 4166395 | 4166470 | gltT | b3969 |
| rRNA | + | 4166664 | 4169567 | rrlB | b3970 |
| rRNA | + | 4169660 | 4169779 | rrfB | b3971 |
| CDS | − | 4170080 | 4171108 | murB | b3972 |
| CDS | + | 4171105 | 4172070 | birA | b3973 |
| CDS | − | 4172099 | 4173049 | coaA | b3974 |
| CDS | − | 4173236 | 4173391 |  | b3975 |
| tRNA | + | 4173411 | 4173486 | thrU | b3976 |
| tRNA | + | 4173495 | 4173579 | tyrU | b3977 |
| tRNA | + | 4173698 | 4173770 | glyT | b3978 |
| tRNA | + | 4173777 | 4173852 | thrT | b3979 |
| CDS | + | 4173967 | 4175151 | tufB | b3980 |
| CDS | + | 4175381 | 4175764 | secE | b3981 |
| CDS | + | 4175766 | 4176311 | nusG | b3982 |
| CDS | + | 4176470 | 4176898 | rplK | b3983 |
| CDS | + | 4176902 | 4177606 | rplA | b3984 |
| CDS | + | 4178019 | 4178516 | rplJ | b3985 |

TABLE 1-continued

| Type | S | Left | Right | Name | B |
|---|---|---|---|---|---|
| CDS | + | 4178583 | 4178948 | rplL | b3986 |
| CDS | + | 4179268 | 4183296 | rpoB | b3987 |
| CDS | + | 4183373 | 4187596 | rpoC | b3988 |
| CDS | + | 4187809 | 4188348 | htrC | b3989 |
| CDS | − | 4188758 | 4189891 | thiH | b3990 |
| CDS | − | 4189888 | 4190658 | thiG | b3991 |
| CDS | − | 4190844 | 4191599 | thiF | b3992 |
| CDS | − | 4191592 | 4192227 | thiE | b3993 |
| CDS | − | 4192227 | 4194122 | thiC | b3994 |
| CDS | − | 4194355 | 4194831 | rsd | b3995 |
| CDS | + | 4194926 | 4195699 | nudC | b3996 |
| CDS | + | 4195739 | 4196803 | hemE | b3997 |
| CDS | + | 4196813 | 4197484 | nfi | b3998 |
| CDS | + | 4197527 | 4198117 | yjaG | b3999 |
| CDS | + | 4198304 | 4198576 | hupA | b4000 |
| CDS | + | 4198589 | 4199284 | yjaH | b4001 |
| CDS | − | 4199286 | 4199711 | zraP | b4002 |
| CDS | + | 4199949 | 4201346 | zraS | b4003 |
| CDS | + | 4201343 | 4202668 | zraR | b4004 |
| CDS | − | 4202665 | 4203954 | purD | b4005 |
| CDS | − | 4203966 | 4205555 | purH | b4006 |
| rRNA | + | 4206170 | 4207711 | rrsE | b4007 |
| tRNA | + | 4207797 | 4207872 | gltV | b4008 |
| rRNA | + | 4208066 | 4210969 | rrlE | b4009 |
| rRNA | + | 4211063 | 4211182 | rrfE | b4010 |
| CDS | + | 4211257 | 4211640 | yjaA | b4011 |
| CDS | − | 4211703 | 4212146 | yjaB | b4012 |
| CDS | + | 4212303 | 4213232 | metA | b4013 |
| CDS | + | 4213501 | 4215102 | aceB | b4014 |
| CDS | + | 4215132 | 4216436 | aceA | b4015 |
| CDS | + | 4216619 | 4218355 | aceK | b4016 |
| CDS | − | 4218324 | 4220510 | arpA | b4017 |
| CDS | − | 4220827 | 4221651 | iclR | b4018 |
| CDS | + | 4221851 | 4225534 | metH | b4019 |
| CDS | + | 4225754 | 4227385 | yjbB | b4020 |
| CDS | − | 4227476 | 4228165 | pepE | b4021 |
| CDS | + | 4228377 | 4229249 | yjbC | b4022 |
| CDS | − | 4229382 | 4229654 | yjbD | b4023 |
| CDS | − | 4229907 | 4231256 | lysC | b4024 |
| CDS | + | 4231781 | 4233430 | pgi | b4025 |
| CDS | + | 4233929 | 4234171 | yjbE | b4026 |
| CDS | + | 4234285 | 4234923 | yjbF | b4027 |
| CDS | + | 4234920 | 4235657 | yjbG | b4028 |
| CDS | + | 4235657 | 4237753 | yjbH | b4029 |
| CDS | + | 4238348 | 4238758 | yjbA | b4030 |
| CDS | − | 4238802 | 4240277 | xylE | b4031 |
| CDS | − | 4240649 | 4241539 | malG | b4032 |
| CDS | − | 4241554 | 4243098 | malF | b4033 |
| CDS | − | 4243252 | 4244442 | malE | b4034 |
| CDS | + | 4244807 | 4245922 | malK | b4035 |
| CDS | + | 4245994 | 4247334 | lamB | b4036 |
| CDS | + | 4247577 | 4248497 | malM | b4037 |
| CDS | + | 4248978 | 4250306 | yjbI | b4038 |
| CDS | + | 4250529 | 4251026 | ubiC | b4039 |
| CDS | + | 4251039 | 4251911 | ubiA | b4040 |
| CDS | − | 4252066 | 4254489 | plsB | b4041 |
| CDS | + | 4254660 | 4255028 | dgkA | b4042 |
| CDS | + | 4255138 | 4255746 | lexA | b4043 |
| CDS | + | 4255765 | 4257144 | dinF | b4044 |
| CDS | + | 4257260 | 4257469 | yjbJ | b4045 |
| CDS | − | 4257511 | 4258026 | zur | b4046 |
| CDS | + | 4258344 | 4258598 | yjbL | b4047 |
| CDS | + | 4258622 | 4259329 | yjbM | b4048 |
| CDS | + | 4259692 | 4260729 | yjbN | b4049 |
| CDS | + | 4260863 | 4261105 | yjbO | b4050 |
| CDS | − | 4261271 | 4262254 | qor | b4051 |
| CDS | + | 4262337 | 4263752 | dnaB | b4052 |
| CDS | + | 4263805 | 4264884 | alr | b4053 |
| CDS | − | 4265137 | 4266330 | tyrB | b4054 |
| CDS | + | 4267437 | 4268150 | aphA | b4055 |
| CDS | + | 4268261 | 4268677 | yjbQ | b4056 |
| CDS | + | 4268681 | 4269037 | yjbR | b4057 |
| CDS | − | 4269072 | 4271894 | uvrA | b4058 |
| CDS | + | 4272148 | 4272684 | ssb | b4059 |
| CDS | − | 4272783 | 4273064 | yjcB | b4060 |
| CDS | + | 4273494 | 4275080 | yjcC | b4061 |
| CDS | − | 4275083 | 4275406 | soxS | b4062 |
| CDS | + | 4275492 | 4275956 | soxR | b4063 |
| CDS | + | 4276502 | 4277851 | yjcD | b4064 |
| CDS | + | 4278003 | 4279652 | yjcE | b4065 |
| CDS | − | 4279806 | 4281098 | yjcF | b4066 |
| CDS | − | 4281276 | 4282925 | actP | b4067 |
| CDS | − | 4282922 | 4283236 | yjcH | b4068 |
| CDS | − | 4283436 | 4285394 | acs | b4069 |
| CDS | + | 4285787 | 4287223 | nrfA | b4070 |
| CDS | + | 4287268 | 4287834 | nrf8 | b4071 |
| CDS | + | 4287831 | 4288502 | nrfC | b4072 |
| CDS | + | 4288499 | 4289455 | nrfD | b4073 |
| CDS | + | 4289535 | 4291193 | nrfE | b4074 |
| CDS | + | 4291186 | 4291569 | nrfF | b4075 |
| CDS | + | 4291566 | 4292162 | nrfG | b4076 |
| CDS | + | 4292504 | 4293817 | gltP | b4077 |
| CDS | − | 4294459 | 4295148 | yjcO | b4078 |
| CDS | − | 4295242 | 4297389 | fdhF | b4079 |
| CDS | − | 4297587 | 4299053 | yjcP | b4080 |
| CDS | − | 4299050 | 4301101 | yjcQ | b4081 |
| CDS | − | 4301101 | 4302132 | yjcR | b4082 |
| CDS | − | 4302635 | 4304620 | yjcS | b4083 |
| CDS | − | 4304893 | 4305822 | alsK | b4084 |
| CDS | − | 4305806 | 4306501 | alsE | b4085 |
| CDS | − | 4306512 | 4307492 | alsC | b4086 |
| CDS | − | 4307471 | 4309003 | alsA | b4087 |
| CDS | − | 4309130 | 4310065 | alsB | b4088 |
| CDS | − | 4310124 | 4311014 | rpiR | b4089 |
| CDS | + | 4311373 | 4311822 | rpiB | b4090 |
| CDS | − | 4312367 | 4313125 | phnP | b4092 |
| CDS | − | 4313127 | 4313561 | phnO | b4093 |
| CDS | − | 4313548 | 4314105 | phnN | b4094 |
| CDS | − | 4314105 | 4315241 | phnM | b4095 |
| CDS | − | 4315238 | 4315918 | phnL | b4096 |
| CDS | − | 4316029 | 4316787 | phnK | b4097 |
| CDS | − | 4316784 | 4317629 | phnJ | b4098 |
| CDS | − | 4317622 | 4318686 | phnI | b4099 |
| CDS | − | 4318686 | 4319270 | phnH | b4100 |
| CDS | − | 4319267 | 4319719 | phnG | b4101 |
| CDS | − | 4319720 | 4320445 | phnF | b4102 |
| CDS | − | 4320466 | 4320834 |  | b4103 |
| CDS | − | 4320684 | 4321304 | phnE | b4104 |
| CDS | − | 4321359 | 4322375 | phnD | b4105 |
| CDS | − | 4322400 | 4323188 | phnC | b4106 |
| CDS | − | 4323321 | 4323764 | phnB | b4107 |
| CDS | − | 4324422 | 4324757 | phnA | b4108 |
| CDS | + | 4325158 | 4327386 | yjdA | b4109 |
| CDS | + | 4327383 | 4328261 | yjcZ | b4110 |
| CDS | + | 4328525 | 4330027 | proP | b4111 |
| CDS | − | 4330204 | 4331295 | basS | b4112 |
| CDS | − | 4331305 | 4331973 | basR | b4113 |
| CDS | − | 4331970 | 4333613 | yjdB | b4114 |
| CDS | − | 4333717 | 4335054 | yjdE | b4115 |
| CDS | − | 4335191 | 4335952 | adiY | b4116 |
| CDS | − | 4336277 | 4338547 | adiA | b4117 |
| CDS | − | 4338743 | 4339651 | melR | b4118 |
| CDS | + | 4339934 | 4341289 | melA | b4119 |
| CDS | + | 4341404 | 4342813 | melB | b4120 |
| CDS | − | 4342952 | 4343581 | yjdF | b4121 |
| CDS | − | 4343703 | 4345349 | fumB | b4122 |
| CDS | − | 4345427 | 4346767 | dcuB | b4123 |
| CDS | − | 4347338 | 4348057 | dcuR | b4124 |
| CDS | − | 4348054 | 4349685 | dcuS | b4125 |
| CDS | + | 4349866 | 4350096 | yjdI | b4126 |
| CDS | + | 4350108 | 4350380 | yjdJ | b4127 |
| CDS | + | 4350607 | 4350903 | yjdK | b4128 |
| CDS | − | 4351223 | 4352740 | lysU | b4129 |
| CDS | − | 4352977 | 4354434 | yjdL | b4130 |
| CDS | − | 4354493 | 4356640 | cadA | b4131 |
| CDS | − | 4356720 | 4358054 | cadB | b4132 |
| CDS | − | 4358419 | 4359957 | cadC | b4133 |
| tRNA | − | 4360574 | 4360649 | pheU | b4134 |
| CDS | − | 4360756 | 4361331 | yjdC | b4135 |
| CDS | − | 4361368 | 4363065 | dsbD | b4136 |
| CDS | − | 4363041 | 4363379 | cutA | b4137 |
| CDS | − | 4363495 | 4364796 | dcuA | b4138 |
| CDS | − | 4364914 | 4366350 | aspA | b4139 |
| CDS | + | 4366687 | 4367163 | fxsA | b4140 |
| CDS | − | 4367179 | 4368435 | yjeH | b4141 |
| CDS | + | 4368711 | 4369004 | groS | b4142 |

TABLE 1-continued

| Type | S | Left | Right | Name | B |
|---|---|---|---|---|---|
| CDS | + | 4369048 | 4370694 | groL | b4143 |
| CDS | + | 4370832 | 4371185 | yjeI | b4144 |
| CDS | − | 4371388 | 4372257 | yjeJ | b4145 |
| CDS | − | 4372652 | 4373680 | yjeK | b4146 |
| CDS | + | 4373722 | 4374288 | efp | b4147 |
| CDS | + | 4374898 | 4375215 | sugE | b4148 |
| CDS | − | 4375212 | 4375745 | blc | b4149 |
| CDS | − | 4375834 | 4376967 | ampC | b4150 |
| CDS | − | 4377030 | 4377389 | frdD | b4151 |
| CDS | − | 4377400 | 4377795 | frdC | b4152 |
| CDS | − | 4377806 | 4378540 | frdB | b4153 |
| CDS | − | 4378533 | 4380341 | frdA | b4154 |
| CDS | + | 4380666 | 4381643 | yjeA | b4155 |
| CDS | + | 4381862 | 4383364 | yjeM | b4156 |
| CDS | + | 4383416 | 4383730 | yjeN | b4157 |
| CDS | + | 4383727 | 4384041 | yjeo | b4158 |
| CDS | − | 4384070 | 4387393 | yjeP | b4159 |
| CDS | − | 4387415 | 4388383 | psd | b4160 |
| CDS | − | 4388480 | 4389532 | yjeQ | b4161 |
| CDS | + | 4389627 | 4390172 | orn | b4162 |
| tRNA | + | 4390383 | 4390458 | glyV | b4163 |
| tRNA | + | 4390495 | 4390570 | glyX | b4164 |
| tRNA | + | 4390606 | 4390681 | glyY | b4165 |
| CDS | − | 4390951 | 4392090 | yjeS | b4166 |
| CDS | + | 4392089 | 4393636 | yjeF | b4167 |
| CDS | + | 4393608 | 4394069 | yjeE | b4168 |
| CDS | + | 4394088 | 4395425 | amiB | b4169 |
| CDS | + | 4395435 | 4397282 | mutL | b4170 |
| CDS | + | 4397275 | 4398225 | miaA | b4171 |
| CDS | + | 4398311 | 4398619 | hfq | b4172 |
| CDS | + | 4398695 | 4399975 | hflX | b4173 |
| CDS | + | 4400061 | 4401320 | hflK | b4174 |
| CDS | + | 4401323 | 4402327 | hflC | b4175 |
| CDS | + | 4402409 | 4402606 | yjeT | b4176 |
| CDS | + | 4402710 | 4404008 | purA | b4177 |
| CDS | − | 4404213 | 4404638 | yjeB | b4178 |
| CDS | + | 4404677 | 4407118 | rnr | b4179 |
| CDS | + | 4407298 | 4408029 | yjfH | b4180 |
| CDS | + | 4408156 | 4408557 | yjfI | b4181 |
| CDS | + | 4408576 | 4409274 | yjfJ | b4182 |
| CDS | + | 4409325 | 4409984 | yjfK | b4183 |
| CDS | + | 4410002 | 4410400 | yjfL | b4184 |
| CDS | + | 4410410 | 4411048 | yjfM | b4185 |
| CDS | − | 4411051 | 4412214 | yjfC | b4186 |
| CDS | + | 4412298 | 4413923 | aidB | b4187 |
| CDS | − | 4414040 | 4414315 | yjfN | b4188 |
| CDS | − | 4414464 | 4414793 | yjfO | b4189 |
| CDS | − | 4414975 | 4415724 | yjfP | b4190 |
| CDS | − | 4415721 | 4416476 | yjfQ | b4191 |
| CDS | − | 4416584 | 4417648 | yjfR | b4192 |
| CDS | + | 4418003 | 4419400 | sgaT | b4193 |
| CDS | + | 4419416 | 4419721 | sgaB | b4194 |
| CDS | + | 4419731 | 4420195 | ptxA | b4195 |
| CDS | + | 4420209 | 4420859 | sgaH | b4196 |
| CDS | + | 4420869 | 4421723 | sgaU | b4197 |
| CDS | + | 4421723 | 4422409 | sgaE | b4198 |
| CDS | − | 4422539 | 4422814 | yjfY | b4199 |
| CDS | + | 4423141 | 4423536 | rpsF | b4200 |
| CDS | + | 4423543 | 4423857 | priB | b4201 |
| CDS | + | 4423862 | 4424089 | rpsR | b4202 |
| CDS | + | 4424131 | 4424580 | rplI | b4203 |
| CDS | − | 4424651 | 4425445 | yjfZ | b4204 |
| CDS | + | 4425792 | 4426118 | ytfA | b4205 |
| CDS | − | 4426102 | 4426740 | ytfB | b4206 |
| CDS | − | 4426958 | 4427578 | fklB | b4207 |
| CDS | + | 4427887 | 4429299 | cycA | b4208 |
| CDS | − | 4429344 | 4430006 | ytfE | b4209 |
| CDS | − | 4430114 | 4431088 | ytfF | b4210 |
| CDS | − | 4431187 | 4432047 | ytfG | b4211 |
| CDS | + | 4432136 | 4432516 | ytfH | b4212 |
| CDS | − | 4432645 | 4434588 | cpdB | b4213 |
| CDS | + | 4434778 | 4435518 | cysQ | b4214 |
| CDS | + | 4435730 | 4436668 | ytfI | b4215 |
| CDS | − | 4436731 | 4437285 | ytfJ | b4216 |
| CDS | + | 4437610 | 4437816 | ytfK | b4217 |
| CDS | − | 4437895 | 4439238 | ytfL | b4218 |
| CDS | − | 4439561 | 4440199 | msrA | b4219 |
| CDS | + | 4440405 | 4442138 | ytfM | b4220 |
| CDS | + | 4442135 | 4445914 | ytfN | b4221 |
| CDS | + | 4445917 | 4446258 | ytfP | b4222 |
| CDS | − | 4445999 | 4446268 | yzfA | b4223 |
| CDS | − | 4446470 | 4446721 | chpS | b4224 |
| CDS | + | 4446715 | 4447065 | chpB | b4225 |
| CDS | − | 4447145 | 4447675 | ppa | b4226 |
| CDS | + | 4447985 | 4448941 | ytfQ | b4227 |
| CDS | + | 4450597 | 4451619 | ytfT | b4230 |
| CDS | + | 4451606 | 4452601 | yjfF | b4231 |
| CDS | − | 4452634 | 4453632 | fbp | b4232 |
| CDS | + | 4453808 | 4455181 | mpl | b4233 |
| CDS | − | 4455337 | 4455888 | yjgA | b4234 |
| CDS | + | 4455982 | 4457334 | pmbA | b4235 |
| CDS | + | 4457576 | 4457878 | cybC | b4236 |
| CDS | − | 4457923 | 4458387 | nrdG | b4237 |
| CDS | − | 4458545 | 4460683 | nrdD | b4238 |
| CDS | − | 4461077 | 4462732 | treC | b4239 |
| CDS | − | 4462782 | 4464203 | treB | b4240 |
| CDS | − | 4464322 | 4465269 | treR | b4241 |
| CDS | − | 4465648 | 4468344 | mgtA | b4242 |
| CDS | − | 4468550 | 4468936 | yjgF | b4243 |
| CDS | − | 4469009 | 4469470 | pyrI | b4244 |
| CDS | − | 4469483 | 4470418 | pyrB | b4245 |
| CDS | − | 4470422 | 4470556 | pyrL | b4246 |
| CDS | + | 4470536 | 4470868 | yjgG | b4247 |
| CDS | − | 4470837 | 4471232 | yjgH | b4248 |
| CDS | − | 4471363 | 4472076 | yjgI | b4249 |
| CDS | + | 4472250 | 4472414 |  | b4250 |
| CDS | + | 4472147 | 4472740 | yjgJ | b4251 |
| CDS | + | 4472885 | 4473337 | yjgK | b4252 |
| CDS | + | 4473460 | 4475274 | yjgL | b4253 |
| CDS | − | 4475330 | 4476334 | argI | b4254 |
| CDS | + | 4476496 | 4476912 | yjgD | b4255 |
| CDS | − | 4477057 | 4477560 | yjgM | b4256 |
| CDS | + | 4477753 | 4478949 | yjgN | b4257 |
| CDS | − | 4479005 | 4481860 | valS | b4258 |
| CDS | − | 4481860 | 4482303 | holC | b4259 |
| CDS | − | 4482463 | 4483974 | pepA | b4260 |
| CDS | + | 4484241 | 4485341 | yjgP | b4261 |
| CDS | + | 4485341 | 4486423 | yjgQ | b4262 |
| CDS | + | 4486584 | 4488086 | yjgR | b4263 |
| CDS | + | 4488164 | 4489162 | idnR | b4264 |
| CDS | + | 4489229 | 4490548 | idnT | b4265 |
| CDS | + | 4490610 | 4491374 | idnO | b4266 |
| CDS | + | 4491398 | 4492429 | idnD | b4267 |
| CDS | + | 4492646 | 4493209 | idnK | b4268 |
| CDS | − | 4493213 | 4494232 | yjgB | b4269 |
| tRNA | + | 4494428 | 4494512 | leuX | b4270 |
| CDS | + | 4494773 | 4495963 | intB | b4271 |
| repeat_region | − | 4496204 | 4497534 |  |  |
| CDS | + | 4496250 | 4496660 | yi21_6 | b4272 |
| CDS | + | 4496618 | 4497523 | yi22_6 | b4273 |
| CDS | + | 4497622 | 4497957 | yjgW | b4274 |
| CDS | − | 4498066 | 4498512 | yjgX | b4275 |
| CDS | − | 4498455 | 4498814 | yjgY | b4276 |
| CDS | + | 4499283 | 4499612 | yjgZ | b4277 |
| repeat_region | − | 4500113 | 4501538 |  |  |
| CDS | + | 4500126 | 4501454 | yi41 | b4278 |
| CDS | + | 4502081 | 4503298 | yjhB | b4279 |
| CDS | + | 4503310 | 4504428 | yjhC | b4280 |
| CDS | − | 4504649 | 4504879 | yjhD | b4281 |
| CDS | − | 4504884 | 4505132 | yjhE | b4282 |
| repeat_region | + | 4505138 | 4505475 |  |  |
| CDS | + | 4505220 | 4505486 | yi91b | b4283 |
| repeat_region | − | 4505482 | 4506702 |  |  |
| CDS | + | 4505489 | 4506640 | tra8_3 | b4284 |
| repeat_region | − | 4506703 | 4507029 |  |  |
| CDS | + | 4506981 | 4507577 |  | b4285 |
| repeat_region | + | 4507030 | 4507824 |  |  |
| CDS | + | 4507743 | 4508156 |  | b4286 |
| CDS | − | 4508713 | 4509480 | fecE | b4287 |
| CDS | − | 4509481 | 4510437 | fecD | b4288 |
| CDS | − | 4510434 | 4511432 | fecC | b4289 |
| CDS | − | 4511429 | 4512331 | fecB | b4290 |
| CDS | − | 4512376 | 4514700 | fecA | b4291 |
| CDS | − | 4514787 | 4515740 | fecR | b4292 |
| CDS | − | 4515737 | 4516258 | fecI | b4293 |
| repeat_region | + | 4516495 | 4517262 |  |  |

TABLE 1-continued

| Type | S | Left | Right | Name | B |
|---|---|---|---|---|---|
| CDS | + | 4516550 | 4516825 | insA_7 | b4294 |
| CDS | − | 4517361 | 4518347 | yjhU | b4295 |
| CDS | − | 4518694 | 4520043 | yjhF | b4296 |
| CDS | − | 4520150 | 4522117 | yjhG | b4297 |
| CDS | − | 4522128 | 4523033 | yjhH | b4298 |
| CDS | − | 4523038 | 4523828 | yjhI | b4299 |
| CDS | − | 4524129 | 4524911 | sgcR | b4300 |
| CDS | − | 4524928 | 4525560 | sgcE | b4301 |
| CDS | − | 4525572 | 4526003 | sgcA | b4302 |
| CDS | − | 4526134 | 4526940 | sgcQ | b4303 |
| CDS | − | 4526953 | 4528266 | sgcC | b4304 |
| CDS | − | 4528553 | 4529674 | sgcX | b4305 |
| CDS | − | 4530460 | 4531206 | yjhP | b4306 |
| CDS | − | 4531262 | 4531807 | yjhQ | b4307 |
| CDS | + | 4533038 | 4534054 | yjhR | b4308 |
| CDS | − | 4534637 | 4535617 | yjhS | b4309 |
| CDS | − | 4535682 | 4536788 | yjhT | b4310 |
| CDS | − | 4536808 | 4537524 | yjhA | b4311 |
| CDS | + | 4538980 | 4539582 | fimB | b4312 |
| CDS | + | 4540060 | 4540656 | fimE | b4313 |
| CDS | + | 4541138 | 4541686 | fimA | b4314 |
| CDS | + | 4541751 | 4542290 | fimI | b4315 |
| CDS | + | 4542327 | 4543052 | fimC | b4316 |
| CDS | + | 4543119 | 4545755 | fimD | b4317 |
| CDS | + | 4545765 | 4546295 | fimF | b4318 |
| CDS | + | 4546308 | 4546811 | fimG | b4319 |
| CDS | + | 4546831 | 4547733 | fimH | b4320 |
| CDS | − | 4547976 | 4549319 | gntP | b4321 |
| CDS | + | 4549659 | 4550843 | uxuA | b4322 |
| CDS | + | 4550924 | 4552384 | uxuB | b4323 |
| CDS | + | 4552599 | 4553372 | uxuR | b4324 |
| CDS | − | 4553513 | 4554343 | yjiC | b4325 |
| CDS | + | 4555016 | 4555408 | yjiD | b4326 |
| CDS | − | 4555401 | 4556312 | yjiE | b4327 |
| CDS | − | 4556517 | 4557549 | iadA | b4328 |
| CDS | − | 4557562 | 4558023 | yjiG | b4329 |
| CDS | − | 4558020 | 4558703 | yjiH | b4330 |
| CDS | + | 4558953 | 4559507 | kptA | b4331 |
| CDS | − | 4559520 | 4560698 | yjiJ | b4332 |
| CDS | − | 4560726 | 4561734 | yjiK | b4333 |
| CDS | − | 4561945 | 4562712 | yjiL | b4334 |
| CDS | − | 4562722 | 4563873 | yjiM | b4335 |
| CDS | − | 4563989 | 4565269 | yjiN | b4336 |
| CDS | − | 4565310 | 4566542 | yjiO | b4337 |
| CDS | + | 4567021 | 4567332 | yjiP | b4338 |
| CDS | + | 4567381 | 4567941 | yjiQ | b4339 |
| CDS | − | 4568185 | 4569597 | yjiR | b4340 |
| CDS | + | 4569774 | 4569938 | yjiS | b4341 |
| CDS | + | 4570437 | 4571954 | yjiT | b4342 |
| CDS | − | 4574935 | 4575981 | mcrC | b4345 |
| CDS | − | 4575981 | 4577360 | mcrB | b4346 |
| CDS | − | 4577522 | 4577920 | yjiW | b4347 |
| CDS | − | 4578091 | 4579485 | hsdS | b4348 |
| CDS | − | 4579482 | 4581071 | hsdM | b4349 |
| CDS | − | 4581272 | 4584838 | hsdR | b4350 |
| CDS | + | 4584972 | 4585886 | mrr | b4351 |
| CDS | − | 4585932 | 4586888 | yjiA | b4352 |
| CDS | − | 4586899 | 4587102 | yjiX | b4353 |
| CDS | − | 4587152 | 4589302 | yjiY | b4354 |
| CDS | + | 4589640 | 4591335 | tsr | b4355 |
| CDS | + | 4591384 | 4592745 | yjiZ | b4356 |
| CDS | − | 4592960 | 4593874 | yjjM | b4357 |
| CDS | + | 4594013 | 4595035 | yjjN | b4358 |
| CDS | − | 4595173 | 4597464 | mdoB | b4359 |
| CDS | − | 4597710 | 4598212 | yjjA | b4360 |
| CDS | − | 4598261 | 4598998 | dnaC | b4361 |
| CDS | − | 4599001 | 4599540 | dnaT | b4362 |
| CDS | − | 4599647 | 4599973 | yjjB | b4363 |
| CDS | − | 4600111 | 4600881 | yjjP | b4364 |
| CDS | + | 4601500 | 4602225 | yjjQ | b4365 |
| CDS | + | 4602237 | 4602860 | bglJ | b4366 |
| CDS | − | 4602898 | 4603686 | fhuF | b4367 |
| tRNA | − | 4604102 | 4604188 | leuV | b4368 |
| tRNA | − | 4604223 | 4604309 | leuP | b4369 |
| tRNA | − | 4604338 | 4604424 | leuQ | b4370 |
| CDS | − | 4604692 | 4605723 | rsmC | b4371 |
| CDS | + | 4605826 | 4606239 | holD | b4372 |
| CDS | + | 4606208 | 4606654 | rimI | b4373 |
| CDS | + | 4606669 | 4607346 | yjjG | b4374 |
| CDS | + | 4607437 | 4609026 | prfC | b4375 |
| CDS | + | 4609419 | 4610024 | osmY | b4376 |
| CDS | + | 4610434 | 4611507 | yjjU | b4377 |
| CDS | + | 4611504 | 4612283 | yjjV | b4378 |
| CDS | − | 4612703 | 4613566 | yjjW | b4379 |
| CDS | − | 4613538 | 4615088 | yjjI | b4380 |
| CDS | + | 4615346 | 4616125 | deoC | b4381 |
| CDS | + | 4616252 | 4617574 | deoA | b4382 |
| CDS | + | 4617626 | 4618849 | deoB | b4383 |
| CDS | + | 4618906 | 4619625 | deoD | b4384 |
| CDS | + | 4619792 | 4621123 | yjjJ | b4385 |
| CDS | − | 4621124 | 4622140 | lplA | b4386 |
| CDS | − | 4622168 | 4622812 | smp | b4387 |
| CDS | + | 4622918 | 4623886 | serB | b4388 |
| CDS | + | 4623935 | 4625317 | sms | b4389 |
| CDS | + | 4625338 | 4626570 | nadR | b4390 |
| CDS | − | 4626878 | 4628545 | yjjK | b4391 |
| CDS | + | 4628756 | 4630693 | slt | b4392 |
| CDS | + | 4630783 | 4631109 | trpR | b4393 |
| CDS | − | 4631256 | 4631768 | yjjX | b4394 |
| CDS | + | 4631820 | 4632467 | gpmB | b4395 |
| CDS | − | 4632464 | 4633333 | rob | b4396 |
| CDS | + | 4633544 | 4634017 | creA | b4397 |
| CDS | + | 4634030 | 4634719 | creB | b4398 |
| CDS | + | 4634719 | 4636143 | creC | b4399 |
| CDS | + | 4636201 | 4637553 | creD | b4400 |
| CDS | + | 4637613 | 4638329 | arcA | b4401 |
| CDS | + | 4638425 | 4638565 | yjjY | b4402 |
| CDS | + | 4638965 | 4639651 | lasT | b4403 |
| CDS | − | 4190660 | 4190860 | thiS | b4407 |
| CDS | + | 4374340 | 4374465 | ecnA | b4410 |
| CDS | + | 4374576 | 4374722 | ecnB | b4411 |
| CDS | + | 1702575 | 1702700 | blr | b4409 |
| misc_RNA | − | 2922178 | 2922537 | csrB | b4408 |
| CDS | + | 213925 | 214125 | yaeP | b4406 |
| misc_RNA | + | 16952 | 17006 | sokC | b4413 |
| misc_RNA | + | 189712 | 189847 | t44 | b4414 |
| misc_RNA | − | 852175 | 852263 | rybA | b4416 |
| misc_RNA | − | 887199 | 887277 | rybB | b4417 |
| misc_RNA | + | 1145812 | 1145980 | sraB | b4418 |
| misc_RNA | + | 1268546 | 1268612 | rdlA | b4420 |
| misc_RNA | + | 1269081 | 1269146 | rdlB | b4422 |
| misc_RNA | + | 1269616 | 1269683 | rdlC | b4424 |
| misc_RNA | − | 1286289 | 1286459 | rtT | b4425 |
| misc_RNA | − | 1403676 | 1403833 | IS061 | b4426 |
| misc_RNA | + | 1435145 | 1435253 | micC | b4427 |
| misc_RNA | + | 1490143 | 1490195 | sokB | b4429 |
| misc_RNA | + | 1762737 | 1762804 | rydB | b4430 |
| misc_RNA | + | 1768396 | 1768500 | rprA | b4431 |
| misc_RNA | + | 1921090 | 1921338 | ryeA | b4432 |
| misc_RNA | − | 1921188 | 1921308 | ryeB | b4433 |
| misc_RNA | − | 1985863 | 1986022 | IS092 | b4434 |
| misc_RNA | + | 2069339 | 2069542 | IS102 | b4435 |
| misc_RNA | + | 2151299 | 2151447 | ryeC | b4436 |
| misc_RNA | + | 2151634 | 2151776 | ryeD | b4437 |
| misc_RNA | + | 2165136 | 2165221 | ryeE | b4438 |
| misc_RNA | − | 2311106 | 2311198 | micF | b4439 |
| misc_RNA | + | 2651877 | 2652180 | ryfA | b4440 |
| misc_RNA | − | 2689214 | 2689362 | tke1 | b4441 |
| misc_RNA | + | 2812523 | 2812897 | sraD | b4442 |
| misc_RNA | + | 2940718 | 2940922 | gcvB | b4443 |
| misc_RNA | − | 2974124 | 2974211 | rygA | b4444 |
| misc_RNA | − | 2974332 | 2974407 | rygB | b4445 |
| misc_RNA | + | 3054837 | 3054987 | rygC | b4446 |
| misc_RNA | + | 3192773 | 3192922 | rygD | b4447 |
| misc_RNA | + | 3236396 | 3236583 | sraF | b4448 |
| misc_RNA | + | 3309247 | 3309420 | sraG | b4449 |
| misc_RNA | + | 3348599 | 3348706 | ryhA | b4450 |
| misc_RNA | + | 3578946 | 3579039 | ryhB | b4451 |
| misc_RNA | + | 3662887 | 3662991 | IS183 | b4452 |
| misc_RNA | + | 3698159 | 3698222 | rdlD | b4454 |
| misc_RNA | + | 3984455 | 3984626 | ryiA | b4456 |
| misc_RNA | + | 4049059 | 4049303 | csrC | b4457 |
| misc_RNA | + | 4156308 | 4156417 | oxyS | b4458 |
| misc_RNA | − | 4275950 | 4276089 | ryjA | b4459 |
| CDS | − | 16751 | 16903 | hokC | b4412 |
| CDS | + | 607059 | 607211 | hokE | b4415 |

TABLE 1-continued

| Type | S | Left | Right | Name | B |
|---|---|---|---|---|---|
| CDS | − | 1268391 | 1268498 | ldrA | b4419 |
| CDS | − | 1268926 | 1269033 | ldrB | b4421 |
| CDS | − | 1269461 | 1269568 | ldrC | b4423 |
| CDS | − | 1489946 | 1490095 | hokB | b4428 |
| CDS | − | 3698003 | 3698110 | ldrD | b4453 |
| CDS | − | 3718471 | 3718623 | hokA | b4455 |
| misc_feature | − | 1588774 | 1588801 | | |
| CDS | − | 1980578 | 1981567 | araH | b4460 |
| CDS | − | 2895986 | 2897440 | | b4463 |
| CDS | − | 3074201 | 3075478 | yggP | b4465 |
| CDS | − | 3112572 | 3117134 | yghJ | b4466 |
| CDS | − | 3122258 | 3123481 | glcF | b4467 |
| CDS | − | 3123492 | 3124544 | glcE | b4468 |
| CDS | − | 3156949 | 3159168 | ygiQ | b4469 |
| CDS | − | 3253363 | 3254673 | yhaM | b4470 |
| CDS | − | 3256307 | 3257671 | tdcG | b4471 |
| CDS | − | 3390480 | 3394280 | yhdP | b4472 |
| CDS | − | 3430458 | 3431582 | smf | b4473 |
| CDS | − | 3553855 | 3554871 | rtcA | b4475 |
| CDS | − | 3573744 | 3575084 | gntU | b4476 |
| CDS | − | 3869873 | 3871021 | dgoD | b4478 |
| CDS | − | 3871018 | 3871635 | dgoA | b4477 |
| CDS | − | 3872494 | 3873183 | dgoR | b4479 |
| CDS | − | 3945151 | 3945990 | hdfR | b4480 |
| CDS | − | 3998315 | 3999079 | yigE | b4482 |
| CDS | + | 2746886 | 2748082 | yfjD | b4461 |
| CDS | + | 2784770 | 2785456 | ygaR | b4462 |
| CDS | + | 3025143 | 3026510 | ygfQ | b4464 |
| CDS | + | 3500362 | 3501192 | frlC | b4474 |
| CDS | + | 3975548 | 3976627 | rffT | b4481 |
| CDS | + | 4021577 | 4022359 | tatD | b4483 |
| CDS | + | 4103843 | 4104343 | cpxP | b4484 |
| CDS | + | 4449081 | 4450583 | ytfR | b4485 |
| CDS | + | 4572158 | 4574878 | yjiV | b4486 |
| CDS | + | 4311891 | 4312220 | yjdP | b4487 |
| CDS | + | 3948583 | 3950227 | ilvG | b4488 |
| prophage | + | 262182 | 296489 | | |
| prophage | + | 564025 | 585326 | | |
| prophage | + | 1195443 | 1210646 | | |
| prophage | + | 1409949 | 1433008 | | |
| prophage | + | 1630310 | 1650778 | | |
| prophage | + | 2064183 | 2077055 | | |
| prophage | + | 2464407 | 2474621 | | |
| prophage | + | 2556721 | 2563510 | | |
| prophage | + | 2753971 | 2776001 | | |
| prophage | + | 4494563 | 4534632 | | |
| CDS | + | 2474332 | 2474532 | torI | b4501 |
| CDS | − | 2263063 | 2263317 | yeiW | b4502 |

TABLE 2

| Strain | Type | Coordinates | Name | B | Function |
|---|---|---|---|---|---|
| MDS01 | CDS | complement(262552 . . . 262893) | | b0245 | orf, hypothetical protein |
| MDS01 | CDS | complement(262914 . . . 263231) | yafW | b0246 | orf, hypothetical protein |
| MDS01 | CDS | complement(263480 . . . 263956) | ykfG | b0247 | putative DNA repair protein |
| MDS01 | CDS | complement(263972 . . . 264430) | yafX | b0248 | orf, hypothetical protein |
| MDS01 | CDS | complement(264528 . . . 264767) | ykfF | b0249 | orf, hypothetical protein |
| MDS01 | CDS | complement(264844 . . . 265311) | ykfB | b0250 | orf, hypothetical protein |
| MDS01 | CDS | complement(265334 . . . 266191) | yafY | b0251 | hypothetical transcriptional regulator |
| MDS01 | CDS | complement(266408 . . . 267244) | yafZ | b0252 | orf, hypothetical protein |
| MDS01 | CDS | complement(267321 . . . 268187) | ykfA | b0253 | putative GTP-binding protein |
| MDS01 | CDS | complement(268513 . . . 269406) | perR | b0254 | peroxide resistance protein |
| MDS01 | CDS | 269466 . . . 269870 | yi91a | b0255 | |
| MDS01 | CDS | 269827 . . . 270978 | tra8_1 | b0256 | IS30 transposase |
| MDS01 | CDS | 271054 . . . 271479 | | b0257 | putative transposase |
| MDS01 | CDS | 272086 . . . 273216 | ykfC | b0258 | orf, hypothetical protein |
| MDS01 | CDS | complement(273325 . . . 274341) | trs5_1 | b0259 | IS5 transposase |
| MDS01 | CDS | 274525 . . . 275952 | ykfB | b0260 | orf, hypothetical protein |
| MDS01 | CDS | 275939 . . . 276871 | yafY | b0261 | hypothetical transcriptional regulator |
| MDS01 | CDS | complement(276980 . . . 278038) | afuC | b0262 | putative ATP-binding component of a transport system |
| MDS01 | CDS | complement(278038 . . . 278400) | | b0263 | |
| MDS01 | CDS | complement(278402 . . . 278905) | insB_2 | b0264 | IS1 protein InsB |
| MDS01 | CDS | complement(278824 . . . 279099) | insA_2 | b0265 | IS1 protein InsA |
| MDS01 | CDS | complement(279609 . . . 279986) | yagB | b0266 | orf, hypothetical protein |
| MDS01 | CDS | complement(280053 . . . 281207) | yagA | b0267 | orf, hypothetical protein |
| MDS01 | CDS | 281481 . . . 282410 | yagE | b0268 | putative lyase/synthase |
| MDS01 | CDS | 282425 . . . 284392 | yagF | b0269 | putative dehydratase |
| MDS01 | CDS | 284619 . . . 286001 | yagG | b0270 | putative permease |
| MDS01 | CDS | 286013 . . . 287623 | yagH | b0271 | putative beta-xylosidase (EC 3.2.1.37 |
| MDS01 | CDS | complement(287628 . . . 288386) | yagI | b0272 | putative regulator |
| MDS01 | CDS | complement(288525 . . . 289529) | argF | b0273 | ornithine carbamoyltransferase 2, chain F |
| MDS01 | CDS | complement(289873 . . . 290376) | insB_3 | b0274 | IS1 protein InsB |
| MDS01 | CDS | complement(290295 . . . 290570) | insA_3 | b0275 | IS1 protein InsA |
| MDS01 | CDS | 290724 . . . 291455 | yagJ | b0276 | orf, hypothetical protein |
| MDS01 | CDS | complement(291546 . . . 292172) | yagK | b0277 | orf, hypothetical protein |
| MDS01 | CDS | complement(292444 . . . 293142) | yagL | b0278 | DNA-binding protein |
| MDS01 | CDS | complement(293169 . . . 294023) | yagM | b0279 | orf, hypothetical protein |
| MDS01 | CDS | complement(294363 . . . 294803) | yagN | b0280 | orf, hypothetical protein |
| MDS01 | CDS | complement(294920 . . . 296320) | intF | b0281 | putative phage integrase |
| MDS01 | CDS | complement(296605 . . . 297015) | yagP | b0282 | putative transcriptional regulator LYSR-type |
| MDS01 | CDS | complement(296994 . . . 297950) | yagQ | b0283 | orf, hypothetical protein |
| MDS01 | CDS | complement(297960 . . . 300158) | yagR | b0284 | orf, hypothetical protein |
| MDS01 | CDS | complement(300155 . . . 301111) | yagS | b0285 | orf, hypothetical protein |
| MDS01 | CDS | complement(301108 . . . 301797) | yagT | b0286 | putative xanthine dehydrogenase (EC 1.1.1.20 |

TABLE 2-continued

| Strain | Type | Coordinates | Name | B | Function |
|---|---|---|---|---|---|
| MDS01 | CDS | 302215 ... 302829 | yagU | b0287 | orf, hypothetical protein |
| MDS01 | CDS | complement(303077 ... 303406) | ykgJ | b0288 | putative ferredoxin |
| MDS01 | CDS | complement(303719 ... 304474) | yagV | b0289 | orf, hypothetical protein |
| MDS01 | CDS | complement(304398 ... 306041) | yagW | b0290 | putative receptor |
| MDS01 | CDS | complement(306031 ... 308556) | yagX | b0291 | putative enzyme |
| MDS01 | CDS | complement(308582 ... 309250) | yagY | b0292 | orf, hypothetical protein |
| MDS01 | CDS | complement(309308 ... 309895) | yagZ | b0293 | orf, hypothetical protein |
| MDS01 | CDS | complement(309970 ... 310560) | ykgK | b0294 | putative regulator |
| MDS01 | CDS | 311336 ... 311563 | ykgL | b0295 | orf, hypothetical protein |
| MDS01 | CDS | complement(311738 ... 312001) | ykgM | b0296 | putative ribosomal protein |
| MDS01 | CDS | 313581 ... 314468 | eaeH | b0297 | attaching and effacing protein, pathogenesis factor |
| MDS01 | CDS | 314506 ... 314814 | | b0298 | |
| MDS01 | CDS | 314811 ... 315677 | tra5_5 | b0299 | |
| MDS01 | CDS | complement(315674 ... 316393) | ykgA | b0300 | putative ARAC-type regulatory protein |
| MDS01 | CDS | complement(316950 ... 317552) | ykgB | b0301 | orf, hypothetical protein |
| MDS01 | CDS | complement(317555 ... 317806) | ykgI | b0303 | orf, hypothetical protein |
| MDS01 | CDS | complement(317900 ... 319252) | ykgC | b0304 | putative oxidoreductase |
| MDS01 | CDS | 319451 ... 320305 | ykgD | b0305 | putative ARAC-type regulatory protein |
| MDS01 | CDS | 320832 ... 321551 | ykgE | b0306 | putative dehydrogenase subunit |
| MDS01 | CDS | 321562 ... 322989 | ykgF | b0307 | orf, hypothetical protein |
| MDS01 | CDS | 322829 ... 323677 | ykgG | b0308 | putative transporter |
| MDS01 | CDS | complement(323632 ... 323844) | | b0309 | orf, hypothetical protein |
| MDS01 | CDS | complement(323920 ... 324588) | ykgH | b0310 | orf, hypothetical protein |
| MDS02 | CDS | complement(1398271 ... 1399803) | ydaH | b1336 | |
| MDS02 | CDS | complement(1399834 ... 1401279) | | b1337 | |
| MDS02 | CDS | complement(1401279 ... 1402604) | ydaJ | b1338 | |
| MDS02 | CDS | 1402765 ... 1403673 | ydaK | b1339 | putative transcriptional regulator LYSR-type |
| MDS02 | CDS | 1404003 ... 1404566 | ydaL | b1340 | orf, hypothetical protein |
| MDS02 | CDS | complement(1404587 ... 1405879) | | b1341 | orf, hypothetical protein |
| MDS02 | CDS | 1406074 ... 1407057 | | b1342 | orf, hypothetical protein |
| MDS02 | CDS | 1407535 ... 1408908 | dbpA | b1343 | ATP-dependent RNA helicase |
| MDS02 | CDS | complement(1409037 ... 1409972) | ydaO | b1344 | orf, hypothetical protein |
| MDS02 | CDS | complement(1410024 ... 1411259) | | b1345 | |
| MDS02 | CDS | complement(1411261 ... 1411500) | ydaQ | b1346 | putative lambdoid prophage Rac excisionase |
| MDS02 | CDS | complement(1411555 ... 1411764) | ydaC | b1347 | orf, hypothetical protein |
| MDS02 | CDS | complement(1411757 ... 1411951) | lar | b1348 | restriction alleviation and modification enhancement |
| MDS02 | CDS | complement(1412008 ... 1412817) | recT | b1349 | recombinase, DNA renaturation |
| MDS02 | CDS | complement(1412810 ... 1415410) | recE | b1350 | exonuclease VIII, ds DNA exonuclease 5' --> 3' specific |
| MDS02 | CDS | complement(1415512 ... 1415787) | racC | b1351 | RacC protein |
| MDS02 | CDS | complement(1416032 ... 1416265) | kil | b1352 | Kil protein (killing function) of lambdoid prophage Rac |
| MDS02 | CDS | 1416572 ... 1417183 | sieB | b1353 | phage superinfection exclusion protein |
| MDS02 | CDS | 1417192 ... 1417368 | | b1354 | orf, hypothetical protein |
| MDS02 | CDS | complement(1417346 ... 1417525) | | b1355 | orf, hypothetical protein |
| MDS02 | CDS | complement(1417789 ... 1418265) | ydaR | b1356 | |
| MDS02 | CDS | 1418389 ... 1418685 | ydaS | b1357 | orf, hypothetical protein |
| MDS02 | CDS | 1418708 ... 1419130 | ydaT | b1358 | orf, hypothetical protein |
| MDS02 | CDS | 1419143 ... 1420000 | ydaU | b1359 | orf, hypothetical protein |
| MDS02 | CDS | 1420007 ... 1420753 | | b1360 | putative DNA replication factor |
| MDS02 | CDS | 1420725 ... 1421336 | ydaW | b1361 | orf, hypothetical protein |
| MDS02 | CDS | 1421363 ... 1421668 | | b1362 | putative Rac prophage endopeptidase |
| MDS02 | CDS | 1421806 ... 1423263 | trkG | b1363 | |
| MDS02 | CDS | 1423202 ... 1423483 | | b1364 | orf, hypothetical protein |
| MDS02 | CDS | 1423401 ... 1423664 | | b1365 | orf, hypothetical protein |
| MDS02 | CDS | 1423645 ... 1424004 | ydaY | b1366 | orf, hypothetical protein |
| MDS02 | CDS | 1424079 ... 1424312 | | b1367 | orf, hypothetical protein |
| MDS02 | CDS | 1424478 ... 1425506 | | b1368 | putative alpha helix protein |
| MDS02 | CDS | 1425482 ... 1425637 | | b1369 | orf, hypothetical protein |
| MDS02 | CDS | complement(1425770 ... 1426750) | trs5_5 | b1370 | |
| MDS02 | CDS | 1426547 ... 1427008 | | b1371 | orf, hypothetical protein |
| MDS02 | CDS | 1427067 ... 1430435 | | b1372 | |
| MDS02 | CDS | 1430435 ... 1431010 | | b1373 | tail fiber assembly protein homolog from lambdoid prophage Rac |
| MDS02 | CDS | complement(1431108 ... 1431698) | | b1374 | |
| MDS02 | CDS | complement(1432015 ... 1432281) | ynaE | b1375 | orf, hypothetical protein |
| MDS02 | CDS | complement(1433209 ... 1433715) | | b1376 | ynaF putative filament protein |
| MDS02 | CDS | complement(1433784 ... 1434917) | | b1377 | |
| MDS02 | CDS | complement(1435284 ... 1438808) | ydbK | b1378 | putative oxidoreductase, Fe—S subunit |
| MDS02 | CDS | complement(1439345 ... 1439767) | hslJ | b1379 | heat shock protein HslJ |
| MDS02 | CDS | complement(1439878 ... 1440867) | ldhA | b1380 | fermentative D-lactate dehydrogenase NAD-dependent |
| MDS02 | CDS | 1441075 ... 1443714 | ydbH | b1381 | orf, hypothetical protein |
| MDS02 | CDS | 1443711 ... 1443896 | ynbE | b1382 | orf, hypothetical protein |

TABLE 2-continued

| Strain | Type | Coordinates | Name | B | Function |
|---|---|---|---|---|---|
| MDS02 | CDS | 1443898 . . . 1444230 | ydbL | b1383 | orf, hypothetical protein |
| MDS02 | CDS | complement(1444402 . . . 1445307) | feaR | b1384 | regulatory protein for 2-phenylethylamine catabolism |
| MDS02 | CDS | 1445540 . . . 1447042 | feaB | b1385 | phenylacetaldehyde dehydrogenase |
| MDS02 | CDS | complement(1447100 . . . 1449373) | tynA | b1386 | copper amine oxidase (tyramine oxidase) |
| MDS02 | CDS | complement(1449621 . . . 1451666) | maoC | b1387 | |
| MDS02 | CDS | 1451951 . . . 1452880 | ydbO | b1388 | |
| MDS02 | CDS | 1452892 . . . 1453179 | ynbF | b1389 | |
| MDS02 | CDS | 1453188 . . . 1453934 | ydbP | b1390 | |
| MDS02 | CDS | 1453943 . . . 1454446 | | b1391 | |
| MDS02 | CDS | 1454454 . . . 1455524 | | b1392 | |
| MDS02 | CDS | 1455521 . . . 1456288 | ydbS | b1393 | |
| MDS02 | CDS | 1456288 . . . 1457076 | | b1394 | |
| MDS02 | CDS | 1457078 . . . 1458505 | ydbU | b1395 | |
| MDS02 | CDS | 1458495 . . . 1458917 | | b1396 | |
| MDS02 | CDS | 1458917 . . . 1460122 | | b1397 | |
| MDS02 | CDS | 1460149 . . . 1461462 | | b1398 | |
| MDS02 | CDS | 1461563 . . . 1462513 | | b1399 | |
| MDS02 | CDS | 1462495 . . . 1463085 | | b1400 | |
| MDS02 | CDS | 1463416 . . . 1465974 | ydbA_1 | b1401 | |
| MDS02 | CDS | complement(1465945 . . . 1466850) | yi22_2 | b1402 | IS2 hypothetical protein |
| MDS02 | CDS | complement(1466808 . . . 1467218) | yi21_2 | b1403 | IS2 hypothetical protein |
| MDS02 | CDS | 1467382 . . . 1468533 | tra8_2 | b1404 | IS30 transposase |
| MDS02 | CDS | 1468714 . . . 1472037 | ydbA_2 | b1405 | |
| MDS02 | CDS | 1472245 . . . 1473105 | ydbC | b1406 | putative dehydrogenase |
| MDS02 | CDS | 1473162 . . . 1475474 | ydbD | b1407 | orf, hypothetical protein |
| MDS02 | CDS | 1475639 . . . 1476250 | | b1408 | |
| MDS02 | CDS | 1476250 . . . 1477146 | | b1409 | putative phosphatidate cytidiltransferase |
| MDS02 | CDS | 1477162 . . . 1478919 | | b1410 | orf, hypothetical protein |
| MDS02 | CDS | 1478933 . . . 1480225 | ynbD | b1411 | putative enzymes |
| MDS02 | misc_RNA | complement(1403676 . . . 1403833) | IS061 | b4426 | |
| MDS02 | misc_RNA | 1435145 . . . 1435252 | tke8 | b4427 | |
| MDS03 | CDS | complement(2555340 . . . 2556743) | eutB | b2441 | ethanolamine ammonia-lyase, heavy chain |
| MDS03 | CDS | 2556793 . . . 2558088 | | b2442 | putative prophage integrase |
| MDS03 | CDS | 2558279 . . . 2558920 | | b2443 | orf, hypothetical protein |
| MDS03 | CDS | 2559390 . . . 2559635 | | b2444 | orf, hypothetical protein |
| MDS03 | CDS | 2559632 . . . 2560015 | | b2445 | orf, hypothetical protein |
| MDS03 | CDS | 2560133 . . . 2560549 | | b2446 | orf, hypothetical protein |
| MDS03 | CDS | 2560546 . . . 2561139 | | b2447 | orf, hypothetical protein |
| MDS03 | CDS | 2561599 . . . 2561991 | | b2448 | orf, hypothetical protein |
| MDS03 | CDS | 2562002 . . . 2562394 | | b2449 | orf, hypothetical protein |
| MDS03 | CDS | 2562515 . . . 2563354 | | b2450 | orf, hypothetical protein |
| MDS04 | CDS | 2754181 . . . 2755422 | intA | b2622 | prophage CP4-57 integrase |
| MDS04 | CDS | complement(2755666 . . . 2756622) | yfjH | b2623 | putative histone |
| MDS04 | CDS | 2756666 . . . 2756878 | alpA | b2624 | prophage CP4-57 regulatory protein alpA |
| MDS04 | CDS | 2757007 . . . 2758416 | yfjI | b2625 | orf, hypothetical protein |
| MDS04 | CDS | 2758569 . . . 2759195 | yfjJ | b2626 | orf, hypothetical protein |
| MDS04 | CDS | complement(2759373 . . . 2761562) | yfjK | b2627 | orf, hypothetical protein |
| MDS04 | CDS | complement(2761559 . . . 2763175) | yfjL | b2628 | orf, hypothetical protein |
| MDS04 | CDS | complement(2763535 . . . 2763798) | yfjM | b2629 | orf, hypothetical protein |
| MDS04 | CDS | 2763940 . . . 2765013 | yfjN | b2630 | putative cell division protein |
| MDS04 | CDS | 2765057 . . . 2765377 | yfjO | b2631 | orf, hypothetical protein |
| MDS04 | CDS | 2765732 . . . 2766595 | yfjP | b2632 | putative GTP-binding protein |
| MDS04 | CDS | 2766687 . . . 2767508 | yfjQ | b2633 | orf, hypothetical protein |
| MDS04 | CDS | 2767725 . . . 2768426 | yfjR | b2634 | orf, hypothetical protein |
| MDS04 | CDS | 2768311 . . . 2768703 | | b2635 | orf, hypothetical protein |
| MDS04 | CDS | 2768454 . . . 2769146 | | b2636 | orf, hypothetical protein |
| MDS04 | CDS | 2769170 . . . 2769637 | yfjT | b2637 | orf, hypothetical protein |
| MDS04 | CDS | complement(2769862 . . . 2770176) | | b2638 | orf, hypothetical protein |
| MDS04 | CDS | complement(2770189 . . . 2770707) | | b2639 | putative pump protein |
| MDS04 | CDS | complement(2770858 . . . 2771058) | | b2640 | orf, hypothetical protein |
| MDS04 | CDS | complement(2770998 . . . 2771114) | | b2641 | orf, hypothetical protein |
| MDS04 | CDS | 2771340 . . . 2773043 | yfjW | b2642 | orf, hypothetical protein |
| MDS04 | CDS | 2773941 . . . 2774399 | yfjX | b2643 | orf, hypothetical protein |
| MDS04 | CDS | 2774408 . . . 2774890 | yfjY | b2644 | putative DNA repair protein |
| MDS04 | CDS | 2775137 . . . 2775454 | yfjZ | b2645 | orf, hypothetical protein |
| MDS04 | CDS | 2775475 . . . 2775804 | ypjF | b2646 | orf, hypothetical protein |
| MDS04 | CDS | complement(2776168 . . . 2780877) | ypjA | b2647 | putative ATP-binding component of a transport system |
| MDS04 | CDS | complement(2781087 . . . 2781230) | | b2648 | orf, hypothetical protein |
| MDS04 | CDS | complement(2781660 . . . 2782451) | | b2649 | orf, hypothetical protein |
| MDS04 | CDS | complement(2782551 . . . 2783033) | | b2650 | orf, hypothetical protein |
| MDS04 | CDS | 2783243 . . . 2783374 | | b2651 | orf, hypothetical protein |
| MDS04 | tRNA | complement(2783784 . . . 2783859) | ileY | b2652 | tRNA-Ile |

TABLE 2-continued

| Strain | Type | Coordinates | Name | B | Function |
|---|---|---|---|---|---|
| MDS04 | CDS | complement(2783822 . . . 2783995) | | b2653 | orf, hypothetical protein |
| MDS04 | CDS | 2784419 . . . 2784751 | | b2654 | orf, hypothetical protein |
| MDS04 | CDS | 2785628 . . . 2786260 | | b2657 | putative enzyme |
| MDS04 | CDS | 2786399 . . . 2786671 | | b2658 | orf, hypothetical protein |
| MDS04 | CDS | 2786902 . . . 2787984 | | b2659 | orf, hypothetical protein |
| MDS04 | CDS | 2787938 . . . 2789272 | ygaF | b2660 | orf, hypothetical protein |
| MDS04 | CDS | 2784770 . . . 2785456 | ygaR | b4462 | orf, hypothetical protein |
| MDS05 | CDS | complement(2064329 . . . 2065345) | trs5_6 | b1994 | IS5 transposase |
| MDS05 | CDS | 2066632 . . . 2067051 | | b1995 | orf, hypothetical protein |
| MDS05 | CDS | complement(2066976 . . . 2067881) | yi22_3 | b1996 | IS2 hypothetical protein |
| MDS05 | CDS | complement(2067839 . . . 2068249) | yi21_3 | b1997 | IS2 hypothetical protein |
| MDS05 | CDS | 2068268 . . . 2068528 | | b1998 | orf, hypothetical protein |
| MDS05 | CDS | 2068525 . . . 2069235 | yeeP | b1999 | putative histone |
| MDS05 | CDS | 2069563 . . . 2072682 | flu | b2000 | antigen 43, phase-variable bipartite outer membrane fluffing protein |
| MDS05 | CDS | 2072797 . . . 2074335 | | b2001 | orf, hypothetical protein |
| MDS05 | CDS | 2074332 . . . 2074778 | yeeS | b2002 | putative DNA repair protein, RADC family |
| MDS05 | CDS | 2074841 . . . 2075062 | yeeT | b2003 | orf, hypothetical protein |
| MDS05 | CDS | 2075136 . . . 2075504 | yeeU | b2004 | putative structural protein |
| MDS05 | CDS | 2075593 . . . 2075967 | yeeV | b2005 | orf, hypothetical protein |
| MDS05 | CDS | 2075964 . . . 2076158 | yeeW | b2006 | orf, hypothetical protein |
| MDS05 | CDS | complement(2077056 . . . 2077451) | yeeX | b2007 | putative alpha helix protein |
| MDS05 | CDS | complement(2077557 . . . 2078615) | yeeA | b2008 | orf, hypothetical protein |
| MDS05 | misc_RNA | 2069339 . . . 2069542 | | b4435 | IS102 |
| MDS06 | CDS | complement(3451530 . . . 3451949) | | b3322 | calcium-binding protein required for initiation of chromosome replication |
| MDS06 | CDS | complement(3451951 . . . 3453420) | yheD | b3323 | putative export protein A for general secretion pathway (GSP) |
| MDS06 | CDS | 3453600 . . . 3454415 | yheE | b3324 | |
| MDS06 | CDS | 3454387 . . . 3456351 | yheF | b3325 | |
| MDS06 | CDS | 3456361 . . . 3457842 | yheG | b3326 | |
| MDS06 | CDS | 3457839 . . . 3459035 | hofF | b3327 | |
| MDS06 | CDS | 3459045 . . . 3459482 | hofG | b3328 | |
| MDS06 | CDS | 3459490 . . . 3459999 | hofH | b3329 | |
| MDS06 | CDS | 3459957 . . . 3460373 | yheH | b3330 | |
| MDS06 | CDS | 3460366 . . . 3460953 | yheI | b3331 | |
| MDS06 | CDS | 3460946 . . . 3461929 | yheJ | b3332 | |
| MDS06 | CDS | 3461941 . . . 3463107 | yheK | b3333 | |
| MDS06 | CDS | 3463080 . . . 3463565 | pshM | b3334 | |
| MDS06 | CDS | 3463565 . . . 3464242 | hofD | b3335 | |
| MDS06 | CDS | complement(3464271 . . . 3464747) | bfr | b3336 | bacterioferrin, an iron storage homoprotein |
| MDS06 | CDS | complement(3464819 . . . 3465013) | yheA | b3337 | |
| MDS06 | CDS | complement(3465182 . . . 3467875) | yheB | b3338 | |
| MDS07 | CDS | 2464567 . . . 2465724 | intC | b2349 | |
| MDS07 | CDS | 2465877 . . . 2466239 | | b2350 | |
| MDS07 | CDS | 2471542 . . . 2471988 | | b2350 | orf, hypothetical protein |
| MDS07 | CDS | 2466236 . . . 2467156 | | b2351 | |
| MDS07 | CDS | 2467153 . . . 2468484 | | b2352 | putative ligase |
| MDS07 | CDS | 2468783 . . . 2469127 | | b2353 | |
| MDS07 | CDS | complement(2469099 . . . 2469539) | | b2354 | orf, hypothetical protein |
| MDS07 | CDS | complement(2469566 . . . 2470084) | yfdL | b2355 | putative RNA polymerase beta |
| MDS07 | CDS | complement(2470134 . . . 2470442) | yfdM | b2356 | orf, hypothetical protein |
| MDS07 | CDS | complement(2470409 . . . 2470903) | yfdN | b2357 | orf, hypothetical protein |
| MDS07 | CDS | complement(2470900 . . . 2471268) | yfdO | b2358 | orf, hypothetical protein |
| MDS07 | CDS | 2472054 . . . 2472878 | | b2360 | orf, hypothetical protein |
| MDS07 | CDS | 2472979 . . . 2473542 | | b2361 | orf, hypothetical protein |
| MDS07 | CDS | 2473533 . . . 2473895 | | b2362 | orf, hypothetical protein |
| MDS07 | CDS | 2473895 . . . 2474200 | | b2363 | orf, hypothetical protein |
| MDS08 | CDS | 1625541 . . . 1626287 | ydfG | b1539 | putative oxidoreductase |
| MDS08 | CDS | 1626376 . . . 1627062 | ydfH | b1540 | orf, hypothetical protein |
| MDS08 | CDS | 1627239 . . . 1627442 | | b1541 | orf, hypothetical protein |
| MDS08 | CDS | complement(1627477 . . . 1628937) | ydfI | b1542 | putative oxidoreductase |
| MDS08 | CDS | complement(1629026 . . . 1630309) | | b1543 | putative transport protein |
| MDS08 | CDS | 1631063 . . . 1631329 | ydfK | b1544 | orf, hypothetical protein |
| MDS08 | CDS | 1631646 . . . 1632236 | | b1545 | |
| MDS08 | CDS | complement(1632334 . . . 1632909) | ydfM | b1546 | tail fiber assembly protein homolog from lambdoid prophage Qin |
| MDS08 | CDS | complement(1632909 . . . 1633871) | | b1547 | |
| MDS08 | CDS | complement(1633822 . . . 1634391) | nohA | b1548 | DNA packaging protein NU1 homolog from lambdoid prophages |
| MDS08 | CDS | 1635056 . . . 1635481 | ydfO | b1549 | orf, hypothetical protein |
| MDS08 | CDS | complement(1635633 . . . 1635809) | | b1550 | |
| MDS08 | CDS | complement(1635978 . . . 1636169) | | b1551 | orf, hypothetical protein |
| MDS08 | CDS | complement(1636479 . . . 1636691) | cspI | b1552 | cold shock-like protein |
| MDS08 | CDS | complement(1637054 . . . 1637551) | | b1553 | orf, hypothetical protein |
| MDS08 | CDS | complement(1637548 . . . 1638081) | | b1554 | |

TABLE 2-continued

| Strain | Type | Coordinates | Name | B | Function |
|---|---|---|---|---|---|
| MDS08 | CDS | complement(1638078 . . . 1638389) | | b1555 | orf, hypothetical protein |
| MDS08 | CDS | complement(1638394 . . . 1638684) | | b1556 | |
| MDS08 | CDS | complement(1639363 . . . 1639578) | cspB | b1557 | |
| MDS08 | CDS | 1639879 . . . 1640091 | cspF | b1558 | |
| MDS08 | CDS | complement(1640513 . . . 1641295) | | b1559 | |
| MDS08 | CDS | complement(1641279 . . . 1642367) | | b1560 | orf, hypothetical protein |
| MDS08 | CDS | complement(1642675 . . . 1642926) | rem | b1561 | orf, hypothetical protein |
| MDS08 | CDS | complement(1643143 . . . 1643298) | hokD | b1562 | polypeptide destructive to membrane potential |
| MDS08 | CDS | complement(1643370 . . . 1643657) | relE | b1563 | orf, hypothetical protein |
| MDS08 | CDS | complement(1643657 . . . 1643896) | relB | b1564 | negative regulator of translation |
| MDS08 | CDS | 1643921 . . . 1644226 | | b1565 | orf, hypothetical protein |
| MDS08 | CDS | 1644429 . . . 1644761 | flxA | b1566 | orf, hypothetical protein |
| MDS08 | CDS | complement(1645198 . . . 1645347) | | b1567 | orf, hypothetical protein |
| MDS08 | CDS | complement(1645370 . . . 1645660) | | b1568 | orf, hypothetical protein |
| MDS08 | CDS | complement(1645644 . . . 1645874) | dicC | b1569 | regulator of dicB |
| MDS08 | CDS | 1645958 . . . 1646365 | dicA | b1570 | regulator of dicB |
| MDS08 | CDS | 1646532 . . . 1646687 | ydfA | b1571 | orf, hypothetical protein |
| MDS08 | CDS | 1646647 . . . 1646817 | ydfB | b1572 | orf, hypothetical protein |
| MDS08 | CDS | 1646847 . . . 1647065 | ydfC | b1573 | orf, hypothetical protein |
| MDS08 | misc_RNA | 1647406 . . . 1647458 | dicF | b1574 | DicF antisense RNA, inhibits ftsZ translation |
| MDS08 | CDS | 1647633 . . . 1647821 | dicB | b1575 | inhibition of cell division |
| MDS08 | CDS | 1647818 . . . 1648009 | ydfD | b1576 | orf, hypothetical protein |
| MDS08 | CDS | 1648102 . . . 1649022 | ydfE | b1577 | orf, hypothetical protein |
| MDS08 | CDS | 1648905 . . . 1649561 | | b1578 | orf, hypothetical protein |
| MDS08 | CDS | 1649536 . . . 1650732 | | b1579 | |
| MDS09 | CDS | complement(4493213 . . . 4494274) | yjgB | b4269 | putative oxidoreductase |
| MDS09 | tRNA | 4494428 . . . 4494512 | leuX | b4270 | tRNA-Leu |
| MDS09 | CDS | 4494773 . . . 4495963 | intB | b4271 | prophage P4 integrase |
| MDS09 | CDS | 4496250 . . . 4496660 | yi21_6 | b4272 | IS2 hypothetical protein |
| MDS09 | CDS | 4496618 . . . 4497523 | yi22_6 | b4273 | IS2 hypothetical protein |
| MDS09 | CDS | 4497622 . . . 4497957 | yjgW | b4274 | orf, hypothetical protein |
| MDS09 | CDS | complement(4498066 . . . 4498512) | yjgX | b4275 | orf, hypothetical protein |
| MDS09 | CDS | complement(4498455 . . . 4498904) | yjgY | b4276 | orf, hypothetical protein |
| MDS09 | CDS | 4499283 . . . 4499612 | yjgZ | b4277 | orf, hypothetical protein |
| MDS09 | CDS | complement(4500126 . . . 4501454) | yi41 | b4278 | IS4 hypothetical protein |
| MDS09 | CDS | 4502021 . . . 4503298 | yjhB | b4279 | putative transport protein |
| MDS09 | CDS | 4503295 . . . 4504428 | yjhC | b4280 | putative dehydrogenase |
| MDS09 | CDS | complement(4504649 . . . 4505023) | yjhD | b4281 | orf, hypothetical protein |
| MDS09 | CDS | 4504929 . . . 4505132 | yjhE | b4282 | orf, hypothetical protein |
| MDS09 | CDS | 4505184 . . . 4505486 | yi91b | b4283 | |
| MDS09 | CDS | complement(4505489 . . . 4506640) | tra8_3 | b4284 | IS30 transposase |
| MDS09 | CDS | 4506981 . . . 4507577 | | b4285 | putative transposase |
| MDS09 | CDS | 4507743 . . . 4508156 | | b4286 | orf, hypothetical protein |
| MDS09 | CDS | complement(4508713 . . . 4509480) | fecE | b4287 | ATP-binding component of citrate-dependent |
| MDS09 | CDS | complement(4509481 . . . 4510437) | fecD | b4288 | citrate-dependent iron transport, membrane-bound protein |
| MDS09 | CDS | complement(4510434 . . . 4511432) | fecC | b4289 | citrate-dependent iron(III) transport protein, cytosolic |
| MDS09 | CDS | complement(4511429 . . . 4512337) | fecB | b4290 | citrate-dependent iron transport, periplasmic protein |
| MDS09 | CDS | complement(4512376 . . . 4514700) | fecA | b4291 | outer membrane receptor; citrate-dependent iron |
| MDS09 | CDS | complement(4514787 . . . 4515740) | fecR | b4292 | outer membrane receptor; citrate-dependent iron transport, outer membrane receptor |
| MDS09 | CDS | complement(4515737 . . . 4516258) | fecI | b4293 | probable RNA polymerase sigma factor |
| MDS09 | CDS | 4516550 . . . 4516825 | insA_7 | b4294 | IS1 protein InsA |
| MDS09 | CDS | complement(4517361 . . . 4518161) | yjhU | b4295 | orf, hypothetical protein |
| MDS09 | CDS | complement(4518694 . . . 4520043) | yjhF | b4296 | putative transport system permease |
| MDS09 | CDS | complement(4520150 . . . 4522117) | yjhG | b4297 | putative dehydratase |
| MDS09 | CDS | complement(4522128 . . . 4523087) | yjhH | b4298 | putative lyase/synthase |
| MDS09 | CDS | complement(4523038 . . . 4523826) | yjhI | b4299 | putative regulator |
| MDS09 | CDS | complement(4524129 . . . 4524911) | sgcR | b4300 | putative DEOR-type transcriptional regulator |
| MDS09 | CDS | complement(4524928 . . . 4525560) | sgcE | b4301 | putative epimerase |
| MDS09 | CDS | complement(4525572 . . . 4526003) | sgcA | b4302 | putative PTS system enzyme II A component |
| MDS09 | CDS | complement(4526134 . . . 4526940) | sgcQ | b4303 | putative nucleoside triphosphatase |
| MDS09 | CDS | complement(4526953 . . . 4528266) | sgcC | b4304 | putative PTS system enzyme IIC component |
| MDS09 | CDS | complement(4528553 . . . 4529704) | sgcX | b4305 | putative lyase/synthase |
| MDS09 | CDS | complement(4530460 . . . 4531206) | yjhP | b4306 | putative methyltransferase |
| MDS09 | CDS | complement(4531262 . . . 4531807) | yjhQ | b4307 | orf, hypothetical protein |
| MDS09 | CDS | 4533038 . . . 4534054 | yjhR | b4308 | putative frameshift suppressor" |

TABLE 2-continued

| Strain | Type | Coordinates | Name | B | Function |
|---|---|---|---|---|---|
| MDS09 | CDS | complement(4534637 ... 4535617) | yjhS | b4309 | orf, hypothetical protein |
| MDS09 | CDS | complement(4535682 ... 4536896) | yjhT | b4310 | orf, hypothetical protein |
| MDS09 | CDS | complement(4536808 ... 4537533) | yjhA | b4311 | orf, hypothetical protein |
| MDS09 | CDS | 4538980 ... 4539582 | fimB | b4312 | recombinase involved in phase variation; regulator for fimA" |
| MDS09 | CDS | 4540060 ... 4540656 | fimE | b4313 | recombinase involved in phase variation; regulator for fimA" |
| MDS09 | CDS | 4541138 ... 4541686 | fimA | b4314 | major type 1 subunit fimbrin (pilin) |
| MDS09 | CDS | 4541643 ... 4542290 | fimI | b4315 | fimbrial protein |
| MDS09 | CDS | 4542327 ... 4543052 | fimC | b4316 | periplasmic chaperone, required for type 1 fimbriae |
| MDS09 | CDS | 4543119 ... 4545755 | fimD | b4317 | outer membrane protein; export and assembly of type 1 fimbriae, interrupted |
| MDS09 | CDS | 4545765 ... 4546295 | fimF | b4318 | fimbrial morphology |
| MDS09 | CDS | 4546308 ... 4546811 | fimG | b4319 | fimbrial morphology |
| MDS09 | CDS | 4546831 ... 4547733 | fimH | b4320 | minor fimbrial subunit, D-mannose specific adhesin |
| MDS10 | CDS | complement(3108612 ... 3109148) | yghD | b2968 | putative secretion pathway protein |
| MDS10 | CDS | complement(3109150 ... 3110010) | yghE | b2969 | putative general secretion pathway for protein export (GSP) |
| MDS10 | CDS | complement(3110076 ... 3110942) | | b2970 | putative general secretion pathway for protein export (GSP) |
| MDS10 | CDS | complement(3111089 ... 3111499) | | b2971 | orf, hypothetical protein |
| MDS10 | CDS | complement(3111565 ... 3112497) | | b2972 | |
| MDS10 | CDS | complement(3117619 ... 3119301) | yghK | b2975 | putative permease |
| MDS10 | CDS | complement(3119656 ... 3121827) | glcB | b2976 | malate synthase G |
| MDS10 | CDS | complement(3121849 ... 3122253) | glcG | b2977 | orf, hypothetical protein |
| MDS10 | CDS | complement(3124544 ... 3126043) | glcD | b2979 | glycolate oxidase subunit D |
| MDS10 | CDS | 3126294 ... 3127058 | glcC | b2980 | transcriptional activator for glc operon |
| MDS10 | CDS | complement(3127065 ... 3128237) | | b2981 | orf, hypothetical protein |
| MDS10 | CDS | 3128200 ... 3129216 | trs5_9 | b2982 | IS5 transposase |
| MDS10 | CDS | complement(3129363 ... 3130430) | yghQ | b2983 | orf, hypothetical protein |
| MDS10 | CDS | complement(3130476 ... 3131234) | yghR | b2984 | orf, hypothetical protein |
| MDS10 | CDS | complement(3131266 ... 3131979) | yghS | b2985 | orf, hypothetical protein |
| MDS10 | CDS | 3132153 ... 3132845 | yghT | b2986 | orf, hypothetical protein |
| MDS10 | CDS | complement(3132894 ... 3134393) | pitB | b2987 | low-affinity phosphate transport |
| MDS10 | CDS | complement(3112572 ... 3117134) | yghJ | b4466 | putative lipoprotein |
| MDS10 | CDS | complement(3122258 ... 3123481) | glcF | b4467 | glycolate oxidase iron-sulfur subunit |
| MDS10 | CDS | complement(3123492 ... 3124544) | glcE | b4468 | glycolate oxidase iron-sulfur subunit |
| MDS11 | CDS | complement(1196090 ... 1196755) | ymfD | b1137 | orf, hypothetical protein |
| MDS11 | CDS | complement(1196756 ... 1197460) | ymfE | b1138 | orf, hypothetical protein |
| MDS11 | CDS | 1197918 ... 1198811 | lit | b1139 | phage T4 late gene expression; at locus of e14 element |
| MDS11 | CDS | complement(1198902 ... 1200029) | intE | b1140 | prophage e14 integrase |
| MDS11 | CDS | complement(1200010 ... 1200255) | | b1141 | |
| MDS11 | CDS | complement(1200292 ... 1200603) | ymfH | b1142 | |
| MDS11 | CDS | 1200675 ... 1201061 | ymfI | b1143 | |
| MDS11 | CDS | complement(1200999 ... 1201283) | ymfJ | b1144 | |
| MDS11 | CDS | complement(1201482 ... 1202156) | | b1145 | |
| MDS11 | CDS | 1201944 ... 1202447 | | b1146 | |
| MDS11 | CDS | 1202479 ... 1203048 | ymfL | b1147 | |
| MDS11 | CDS | 1203045 ... 1203383 | ymfM | b1148 | |
| MDS11 | CDS | 1203393 ... 1204760 | ymfN | b1149 | |
| MDS11 | CDS | 1204772 ... 1204954 | ymfR | b1150 | |
| MDS11 | CDS | 1204954 ... 1205427 | ymfO | b1151 | |
| MDS11 | CDS | 1205354 ... 1206145 | | b1152 | |
| MDS11 | CDS | 1206136 ... 1206720 | | b1153 | |
| MDS11 | CDS | 1206724 ... 1207353 | ycfK | b1154 | |
| MDS11 | CDS | 1207355 ... 1207768 | | b1155 | |
| MDS11 | CDS | complement(1207740 ... 1208342) | ycfA | b1156 | |
| MDS11 | CDS | complement(1208342 ... 1208881) | | b1157 | |
| MDS11 | CDS | 1208908 ... 1209462 | pin | b1158 | inversion of adjacent DNA; at locus of e14 element |
| MDS11 | CDS | 1209569 ... 1210402 | mcrA | b1159 | restriction of DNA at 5-methylcytosine residues; at locus of e14 element |
| MDS11 | CDS | complement(1210903 ... 1211226) | ycgW | b1160 | orf, hypothetical protein |
| MDS11 | CDS | complement(1211926 ... 1212330) | ycgX | b1161 | orf, hypothetical protein |
| MDS11 | CDS | complement(1212551 ... 1213282) | ycgE | b1162 | putative transcriptional regulator |
| MDS11 | CDS | complement(1213487 ... 1214698) | | b1163 | orf, hypothetical protein |
| MDS11 | CDS | 1215012 ... 1215248 | ycgZ | b1164 | orf, hypothetical protein |
| MDS11 | CDS | 1215291 ... 1215563 | ymgA | b1165 | orf, hypothetical protein |
| MDS11 | CDS | 1215592 ... 1215858 | ymgB | b1166 | orf, hypothetical protein |
| MDS11 | CDS | 1215971 ... 1216219 | ymgC | b1167 | orf, hypothetical protein |
| MDS11 | CDS | 1216509 ... 1218074 | | b1168 | putative proteases |
| MDS11 | CDS | 1218824 ... 1220344 | | b1169 | putative ATP-binding component of a transport system |

TABLE 2-continued

| Strain | Type | Coordinates | Name | B | Function |
|---|---|---|---|---|---|
| MDS11 | CDS | 1220429 ... 1221445 | | b1170 | |
| MDS11 | CDS | complement(1221528 ... 1221863) | | b1171 | orf, hypothetical protein |
| MDS11 | CDS | complement(1221867 ... 1222151) | | b1172 | orf, hypothetical protein |
| MDS12 | CDS | complement(564038 ... 565201) | intD | b0537 | prophage DLP12 integrase |
| MDS12 | CDS | 565195 ... 565755 | | b0538 | putative sensory transduction regulator |
| MDS12 | CDS | complement(565321 ... 565584) | | b0539 | |
| MDS12 | CDS | 566056 ... 566364 | | b0540 | |
| MDS12 | CDS | 566361 ... 567227 | tra5_2 | b0541 | |
| MDS12 | CDS | 567333 ... 567470 | | b0542 | orf, hypothetical protein |
| MDS12 | CDS | 567538 ... 567870 | emrE | b0543 | methylviologen resistance |
| MDS12 | CDS | 568125 ... 569651 | ybcK | b0544 | orf, hypothetical protein |
| MDS12 | CDS | 570116 ... 570667 | ybcL | b0545 | orf, hypothetical protein |
| MDS12 | CDS | 570677 ... 571474 | ybcM | b0546 | putative ARAC-type regulatory protein |
| MDS12 | CDS | 571689 ... 572144 | ybcN | b0547 | orf, hypothetical protein |
| MDS12 | CDS | 572144 ... 572314 | ninE | b0548 | similar to phage 82 and lambda proteins |
| MDS12 | CDS | 572307 ... 572597 | ybcO | b0549 | orf, hypothetical protein |
| MDS12 | CDS | 572594 ... 572956 | rus | b0550 | endodeoxyribonuclease RUS (Holliday junction resolvase) |
| MDS12 | CDS | 573179 ... 573562 | ybcQ | b0551 | orf, hypothetical protein |
| MDS12 | CDS | complement(573960 ... 574976) | trs5_2 | b0552 | IS5 transposase |
| MDS12 | CDS | complement(574981 ... 576108) | nmpC | b0553 | outer membrane porin protein; locus of qsr prophage |
| MDS12 | CDS | 576621 ... 576836 | ybcR | b0554 | orf, hypothetical protein |
| MDS12 | CDS | 576836 ... 577333 | ybcS | b0555 | bacteriophage lambda lysozyme homolog |
| MDS12 | CDS | 577330 ... 577791 | ybcT | b0556 | bacteriophage lambda endopeptidase homolog |
| MDS12 | CDS | complement(577823 ... 578116) | ybcU | b0557 | bacteriophage lambda Bor protein homolog |
| MDS12 | CDS | complement(578407 ... 578859) | ybcV | b0558 | putative an envelop protein |
| MDS12 | CDS | 579103 ... 579309 | ybcW | b0559 | orf, hypothetical protein |
| MDS12 | CDS | 580057 ... 580602 | nohB | b0560 | bacteriophage DNA packaging protein |
| MDS12 | CDS | 580577 ... 581320 | ybcX | b0561 | orf, hypothetical protein |
| MDS12 | CDS | complement(581375 ... 581959) | ybcY | b0562 | orf, hypothetical protein |
| MDS12 | CDS | 582098 ... 582283 | ylcE | b0563 | orf, hypothetical protein |
| MDS12 | CDS | 582904 ... 583653 | appY | b0564 | regulatory protein affecting appA and other genes |
| MDS12 | CDS | complement(583903 ... 584856) | ompT | b0565 | outer membrane protein 3b (a), protease VII |
| MDS13 | CDS | 15445 ... 16557 | yi81_ | b0016 | IS186 hypothetical protein 1 |
| MDS13 | CDS | complement(15869 ... 16177) | yi82_1 | b0017 | |
| MDS13 | CDS | complement(16751 ... 16960) | mokC | b0018 | regulatory peptide whose translation enables hokC (gef) expression |
| MDS13 | CDS | 17489 ... 18655 | nhaA | b0019 | Na+/H antiporter, pH dependent |
| MDS13 | CDS | 18715 ... 19620 | nhaR | b0020 | transcriptional activator of nhaA |
| MDS13 | CDS | complement(19811 ... 20314) | insB_1 | b0021 | IS1 protein InsB |
| MDS13 | CDS | complement(20233 ... 20508) | insA | b0022 | IS1 protein InsA_1 |
| MDS13 | CDS | complement(16751 ... 16903) | hokC | b4412 | small toxic membrane polypeptide |
| MDS13 | misc_RNA | 16952 ... 17006 | sokC | b4413 | antisense RNA blocking mokC (orf69) and hokC (gef) translation |
| MDS14 | CDS | complement(602639 ... 603886) | ybdG | b0577 | putative transport |
| MDS14 | CDS | complement(603994 ... 604647) | nfnB | b0578 | oxygen-insensitive NAD(P)H nitroreductase |
| MDS14 | CDS | complement(604741 ... 605109) | ybdF | b0579 | orf, hypothetical protein |
| MDS14 | CDS | complement(605174 ... 605422) | ybdJ | b0580 | orf, hypothetical protein |
| MDS14 | CDS | complement(605488 ... 606606) | ybdK | b0581 | orf, hypothetical protein |
| MDS14 | CDS | 607288 ... 608400 | yi81_2 | b0582 | IS186 hypothetical protein 2 |
| MDS14 | CDS | 607059 ... 607211 | hokE | b4415 | small toxic membrane polypeptide |
| MDS15 | CDS | 2507652 ... 2508908 | | b2389 | orf, hypothetical protein |
| MDS15 | CDS | 2509023 ... 2509349 | ypeC | b2390 | orf, hypothetical protein |
| MDS15 | CDS | complement(2509490 ... 2510728) | | b2392 | |
| MDS15 | CDS | 2511064 ... 2512266 | nupC | b2393 | permease of transport system for 3 nucleosides |
| MDS15 | CDS | 2512347 ... 2513465 | yi81_3 | b2394 | |
| MDS15 | CDS | complement(2513665 ... 2515971) | yfeA | b2395 | orf, hypothetical protein |
| MDS16 | CDS | complement(379293 ... 380066) | yaiO | b0358 | orf, hypothetical protein |
| MDS16 | CDS | complement(380068 ... 380511) | | b0359 | putative transferase |
| MDS16 | CDS | 380530 ... 380940 | yi21_1 | b0360 | IS2 hypothetical protein |
| MDS16 | CDS | 380898 ... 381803 | yi22_1 | b0361 | IS2 hypothetical protein |
| MDS16 | CDS | complement(381728 ... 382114) | | b0362 | orf, hypothetical protein |
| MDS16 | CDS | complement(381963 ... 383159) | yaiP | b0363 | polysaccharide metabolism |
| MDS16 | CDS | complement(383283 ... 383693) | yaiS | b0364 | orf, hypothetical protein |
| MDS16 | CDS | 384399 ... 385418 | tauA | b0365 | taurine transport system periplasmic protein |
| MDS16 | CDS | 385431 ... 386198 | tauB | b0366 | taurine ATP-binding component of a transport system |

TABLE 2-continued

| Strain | Type | Coordinates | Name | B | Function |
|---|---|---|---|---|---|
| MDS16 | CDS | 386195 ... 387022 | tauC | b0367 | taurine transport system permease protein |
| MDS16 | CDS | 387019 ... 387870 | tauD | b0368 | taurine dioxygenase, 2-oxoglutarate-dependent |
| MDS17 | CDS | complement(389121 ... 389390) | | b0370 | orf, hypothetical protein |
| MDS17 | CDS | 389475 ... 390935 | yaiT | b0371 | orf, hypothetical protein |
| MDS17 | CDS | complement(390963 ... 391829) | tra5_1 | b0372 | |
| MDS17 | CDS | complement(391826 ... 392134) | | b0373 | putative flagellin structural protein |
| MDS17 | CDS | 392239 ... 393642 | yaiU | b0374 | putative flagellin structural protein |
| MDS17 | CDS | 393685 ... 394353 | yaiV | b0375 | orf, hypothetical protein |
| MDS17 | CDS | complement(394354 ... 395511) | yaiH | b0376 | |
| MDS17 | CDS | 395863 ... 397083 | sbmA | b0377 | sensitivity to microcin B17, possibly envelope protein |
| MDS17 | CDS | 397096 ... 398190 | yaiW | b0378 | orf, hypothetical protein |
| MDS17 | CDS | complement(398249 ... 398557) | yaiY | b0379 | orf, hypothetical protein |
| MDS17 | CDS | 398685 ... 399029 | | b0380 | orf, hypothetical protein |
| MDS18 | CDS | complement(2992959 ... 2993114) | | b2856 | orf, hypothetical protein |
| MDS18 | CDS | complement(2993336 ... 2993767) | | b2857 | orf, hypothetical protein |
| MDS18 | CDS | complement(2993770 ... 2993991) | | b2858 | orf, hypothetical protein |
| MDS18 | CDS | complement(2993984 ... 2994409) | | b2859 | orf, hypothetical protein |
| MDS18 | CDS | complement(2994394 ... 2995299) | yi22_4 | b2860 | IS2 hypothetical protein |
| MDS18 | CDS | complement(2995257 ... 2995622) | yi21_4 | b2861 | IS2 hypothetical protein |
| MDS18 | CDS | complement(2995711 ... 2996010) | | b2862 | orf, hypothetical protein |
| MDS18 | CDS | complement(2996056 ... 2996892) | | b2863 | orf, hypothetical protein |
| MDS19 | CDS | 3182802 ... 3183152 | | b3042 | orf, hypothetical protein |
| MDS19 | CDS | 3183436 ... 3183987 | ygiL | b3043 | putative fimbrial-like protein |
| MDS19 | CDS | 3184209 ... 3184574 | yi21_5 | b3044 | IS2 hypothetical protein |
| MDS19 | CDS | 3184532 ... 3185437 | yi22_5 | b3045 | IS2 hypothetical protein |
| MDS19 | CDS | 3185422 ... 3187887 | yqiG | b3046 | putative membrane protein |
| MDS19 | CDS | 3187894 ... 3188652 | yqiH | b3047 | putative membrane protein |
| MDS19 | CDS | 3188654 ... 3189718 | yqiI | b3048 | orf, hypothetical protein |
| MDS20 | CDS | complement(687220 ... 688236) | trs5_3 | b0656 | IS5 transposase |
| MDS21 | CDS | 1386912 ... 1387919 | ycjG | b1325 | putative muconate cycloisomerase I (EC 5.5 |
| MDS21 | CDS | complement(1387894 ... 1388682) | ycjI | b1326 | putative carboxypeptidase |
| MDS21 | CDS | complement(1388957 ... 1389889) | | b1327 | orf, hypothetical protein |
| MDS21 | CDS | 1390015 ... 1390914 | ycjZ | b1328 | putative transcriptional regulator LYSR-type |
| MDS21 | CDS | 1391230 ... 1392864 | | b1329 | |
| MDS21 | CDS | complement(1392915 ... 1393946) | | b1330 | orf, hypothetical protein |
| MDS21 | CDS | 1394100 ... 1395116 | trs5_4 | b1331 | IS5 transposase |
| MDS21 | CDS | 1395389 ... 1395646 | ynaJ | b1332 | orf, hypothetical protein |
| MDS21 | CDS | complement(1395696 ... 1396646) | ydaA | b1333 | orf, hypothetical protein |
| MDS22 | CDS | complement(2099919 ... 2100935) | trs5_7 | b2030 | |
| MDS22 | CDS | complement(2100940 ... 2101413) | yefJ | b2031 | |
| MDS22 | CDS | complement(2101415 ... 2102533) | wbbK | b2032 | putative glucose transferase |
| MDS22 | CDS | complement(2102518 ... 2103108) | wbbJ | b2033 | putative O-acetyl transferase |
| MDS22 | CDS | complement(2103089 ... 2104081) | wbbI | b2034 | putative Galf transferase |
| MDS22 | CDS | complement(2104084 ... 2105250) | wbbH | b2035 | O-antigen polymerase |
| MDS22 | CDS | complement(2105250 ... 2106353) | glf | b2036 | UDP-galactopyranose mutase |
| MDS22 | CDS | complement(2106361 ... 2107608) | rfbX | b2037 | putative O-antigen transporter |
| MDS22 | CDS | complement(2107605 ... 2108162) | rfbC | b2038 | dTDP-6-deoxy-D-glucose-3,5 epimerase |
| MDS22 | CDS | complement(2108162 ... 2109043) | rfbA | b2039 | glucose-1-phosphate thymidylyltransferase |
| MDS22 | CDS | complement(2109101 ... 2110000) | rfbD | b2040 | dTDP-6-deoxy-L-mannose-dehydrogenase |
| MDS22 | CDS | complement(2110000 ... 2111085) | rfbB | b2041 | dTDP-glucose 4,6 dehydratase |
| MDS22 | CDS | complement(2111458 ... 2112351) | galF | b2042 | homolog of Salmonella UTP--glucose-1-P uridyltransferase, probably a UDP-gal transferase |
| MDS22 | CDS | complement(2112526 ... 2113920) | wcaM | b2043 | orf, hypothetical protein |
| MDS22 | CDS | complement(2113931 ... 2115151) | wcaL | b2044 | putative colanic acid biosynthesis glycosyl transferase |
| MDS22 | CDS | complement(2115148 ... 2116428) | wcaK | b2045 | putative galactokinase (EC 2.7.1.6 |
| MDS22 | CDS | complement(2116704 ... 2118182) | wzxC | b2046 | probable export protein |
| MDS22 | CDS | complement(2118184 ... 2119578) | wcaJ | b2047 | putative colanic acid biosynthsis UDP-glucose lipid carrier transferase |
| MDS22 | CDS | complement(2119633 ... 2121003) | cpsG | b2048 | phosphomannomutase |
| MDS22 | CDS | complement(2121108 ... 2122544) | cpsB | b2049 | mannose-1-phosphate guanyltransferase |
| MDS22 | CDS | complement(2122547 ... 2123770) | wcaI | b2050 | putative colanic biosynthesis glycosyl transferase |
| MDS22 | CDS | complement(2123767 ... 2124249) | wcaH | b2051 | GDP-mannose mannosyl hydrolase |
| MDS22 | CDS | complement(2124249 ... 2125214) | wcaG | b2052 | putative nucleotide di-P-sugar epimerase or dehydratase |
| MDS22 | CDS | complement(2125217 ... 2126338) | gmd | b2053 | GDP-D-mannose dehydratase |
| MDS22 | CDS | complement(2126364 ... 2126912) | wcaF | b2054 | putative transferase |

TABLE 2-continued

| Strain | Type | Coordinates | Name | B | Function |
|---|---|---|---|---|---|
| MDS22 | CDS | complement(2126928 ... 2127674) | wcaE | b2055 | putative colanic acid biosynthesis glycosyl transferase |
| MDS22 | CDS | complement(2127685 ... 2128902) | wcaD | b2056 | putative colanic acid polymerase |
| MDS22 | CDS | complement(2128877 ... 2130094) | wcaC | b2057 | putative glycosyl transferase |
| MDS22 | CDS | complement(2130091 ... 2130579) | wcaB | b2058 | putative transferase |
| MDS22 | CDS | complement(2130582 ... 2131421) | wcaA | b2059 | putative regulator |
| MDS22 | CDS | complement(2131514 ... 2133712) | | b2060 | |
| MDS22 | CDS | complement(2133679 ... 2134122) | wzb | b2061 | low molecular weight protein-tyrosine-phosphatase |
| MDS22 | CDS | complement(2134128 ... 2135267) | wza | b2062 | putative polysaccharide export protein |
| MDS23 | CDS | complement(2284412 ... 2286922) | yejO | b2190 | putative ATP-binding component of a transport system |
| MDS23 | CDS | 2286927 ... 2287049 | | b2191 | orf, hypothetical protein |
| MDS23 | CDS | complement(2287087 ... 2288103) | trs5_8 | b2192 | IS5 transposase |
| MDS24 | CDS | 3360134 ... 3360808 | yhcA | b3215 | putative chaperone |
| MDS24 | CDS | 3360829 ... 3363210 | yhcD | b3216 | putative outer membrane protein |
| MDS24 | CDS | 3363207 ... 3363686 | yhcE | b3217 | orf, hypothetical protein |
| MDS24 | CDS | complement(3363724 ... 3364740) | trs5_10 | b3218 | IS5 transposase |
| MDS24 | CDS | 3364948 ... 3365664 | yhcF | b3219 | putative transcriptional regulator |
| MDS25 | CDS | 3649314 ... 3650096 | yhiS | b3504 | orf, hypothetical protein |
| MDS25 | CDS | complement(3650205 ... 3651221) | trs5_11 | b3505 | IS5 transposase |
| MDS26 | CDS | complement(1128637 ... 1129053) | flgN | b1070 | protein of flagellar biosynthesis |
| MDS26 | CDS | complement(1129058 ... 1129351) | flgM | b1071 | anti-FliA (anti-sigma) factor; also known as RflB protein |
| MDS26 | CDS | complement(1129427 ... 1130086) | flgA | b1072 | flagellar biosynthesis; assembly of basal-body periplasmic P ring |
| MDS26 | CDS | 1130241 ... 1130657 | flgB | b1073 | flagellar biosynthesis, cell-proximal portion of basal-body rod |
| MDS26 | CDS | 1130661 ... 1131065 | flgC | b1074 | flagellar biosynthesis, cell-proximal portion of basal-body rod |
| MDS26 | CDS | 1131077 ... 1131772 | flgD | b1075 | flagellar biosynthesis, initiation of hook assembly |
| MDS26 | CDS | 1131797 ... 1133005 | flgE | b1076 | flagellar biosynthesis, hook protein |
| MDS26 | CDS | 1133025 ... 1133780 | flgF | b1077 | flagellar biosynthesis, cell-proximal portion of basal-body rod |
| MDS26 | CDS | 1133952 ... 1134734 | flgG | b1078 | flagellar biosynthesis, cell-distal portion of basal-body rod |
| MDS26 | CDS | 1134787 ... 1135485 | flgH | b1079 | flagellar biosynthesis, basal-body outer-membrane L (lipopolysaccharide layer) ring protein |
| MDS26 | CDS | 1135497 ... 1136594 | flgI | b1080 | homolog of Salmonella P-ring of flagella basal body |
| MDS26 | CDS | 1136594 ... 1137535 | flgJ | b1081 | flagellar biosynthesis |
| MDS26 | CDS | 1137601 ... 1139244 | flgK | b1082 | flagellar biosynthesis, hook-filament junction protein 1 |
| MDS26 | CDS | 1139256 ... 1140209 | flgL | b1083 | flagellar biosynthesis; hook-filament junction protein |
| MDS27 | CDS | complement(1960604 ... 1960996) | flhE | b1878 | flagellar biosynthesis |
| MDS27 | CDS | complement(1960996 ... 1963074) | flhA | b1879 | flagellar biosynthesis; possible export of flagellar proteins |
| MDS27 | CDS | complement(1963067 ... 1964215) | flhB | b1880 | putative part of export apparatus for flagellar proteins |
| MDS27 | CDS | complement(1964417 ... 1965061) | cheZ | b1881 | chemotactic response; CheY protein phophatase; antagonist of CheY as switch regulator |
| MDS27 | CDS | complement(1965072 ... 1965461) | cheY | b1882 | chemotaxis regulator transmits chemoreceptor signals to flagelllar motor components |
| MDS27 | CDS | complement(1965476 ... 1966525) | cheB | b1883 | response regulator for chemotaxis (cheA sensor); protein methylesterase |
| MDS27 | CDS | complement(1966528 ... 1967388) | cheR | b1884 | response regulator for chemotaxis protein glutamate methyltransferase |
| MDS27 | CDS | complement(1967407 ... 1969008) | tap | b1885 | methyl-accepting chemotaxis protein IV peptide sensor receptor |
| MDS27 | CDS | complement(1969054 ... 1970715) | tar | b1886 | methyl-accepting chemotaxis protein II aspartate sensor receptor |
| MDS27 | CDS | complement(1970860 ... 1971363) | cheW | b1887 | positive regulator of CheA protein activity |
| MDS27 | CDS | complement(1971384 ... 1973348) | cheA | b1888 | sensory transducer kinase between chemo-signal receptors and CheB and CheY |
| MDS27 | CDS | complement(1973353 ... 1974279) | motB | b1889 | enables flagellar motor rotation linking torque machinery to cell wall |
| MDS27 | CDS | complement(1974276 ... 1975163) | motA | b1890 | proton conductor component of motor; no effect on switching |
| MDS27 | CDS | complement(1975290 ... 1975868) | flhC | b1891 | regulator of flagellar biosynthesis acting on class 2 operons; transcription initiation factor |

TABLE 2-continued

| Strain | Type | Coordinates | Name | B | Function |
|---|---|---|---|---|---|
| MDS27 | CDS | complement(1975871 . . . 1976230) | flhD | b1892 | regulator of flagellar biosynthesis acting on class 2 operons; transcription initiation factor |
| MDS27 | CDS | complement(1976542 . . . 1977045) | insB_5 | b1893 | IS1 protein InsB |
| MDS27 | CDS | complement(1976964 . . . 1977239) | insA_5 | b1894 | IS1 protein InsA |
| MDS28 | CDS | complement(1995086 . . . 1995838) | yecC | b1917 | putative ATP-binding component of a transport system |
| MDS28 | CDS | complement(1995835 . . . 1996503) | yecS | b1918 | putative transport system permease protein (former yecC) |
| MDS28 | CDS | complement(1996518 . . . 1997600) | yedO | b1919 | putative 1-aminocyclopropane-1-carboxylate deaminase |
| MDS28 | CDS | complement(1997609 . . . 1998409) | fliY | b1920 | putative periplasmic binding transport protein |
| MDS28 | CDS | complement(1998497 . . . 1999084) | fliZ | b1921 | orf, hypothetical protein |
| MDS28 | CDS | complement(1999094 . . . 1999813) | fliA | b1922 | flagellar biosynthesis; alternative sigma factor 28; regulation of flagellar operons |
| MDS28 | CDS | complement(2000134 . . . 2001630) | fliC | b1923 | flagellar biosynthesis; flagellin filament structural protein |
| MDS28 | CDS | 2001896 . . . 2003302 | fliD | b1924 | flagellar biosynthesis; filament capping protein; enables filament assembly |
| MDS28 | CDS | 2003327 . . . 2003737 | fliS | b1925 | flagellar biosynthesis; repressor of class 3a and 3b operons (RflA activity) |
| MDS28 | CDS | 2003737 . . . 2004102 | fliT | b1926 | flagellar biosynthesis; repressor of class 3a and 3b operons (RflA activity) |
| MDS28 | CDS | 2004180 . . . 2005667 | amyA | b1927 | cytoplasmic alpha-amylase |
| MDS28 | CDS | complement(2005701 . . . 2006114) | yedD | b1928 | orf, hypothetical protein |
| MDS28 | CDS | 2006301 . . . 2007506 | yedE | b1929 | putative transport system permease protein |
| MDS28 | CDS | 2007503 . . . 2007736 | yedF | b1930 | orf, hypothetical protein |
| MDS28 | CDS | 2007845 . . . 2008513 | yedK | b1931 | orf, hypothetical protein |
| MDS28 | CDS | 2008624 . . . 2009103 | yedL | b1932 | orf, hypothetical protein |
| MDS28 | CDS | complement(2009372 . . . 2009563) | | b1933 | orf, hypothetical protein |
| MDS28 | CDS | complement(2009573 . . . 2009893) | yedN | b1934 | orf, hypothetical protein |
| MDS28 | CDS | complement(2010025 . . . 2010375) | yedM | b1935 | orf, hypothetical protein |
| MDS28 | CDS | 2010526 . . . 2010804 | | b1936 | orf, hypothetical protein |
| MDS28 | CDS | complement(2010724 . . . 2011038) | fliE | b1937 | flagellar biosynthesis; basal-body component, possibly at (MS-ring)-rod junction |
| MDS28 | CDS | 2011253 . . . 2012911 | fliF | b1938 | flagellar biosynthesis; basal-body MS(membrane and supramembrane)-ring and collar protein |
| MDS28 | CDS | 2012904 . . . 2013899 | fliG | b1939 | flagellar biosynthesis, component of motor switching and energizing, enabling rotation and determinin its direction |
| MDS28 | CDS | 2013871 . . . 2014578 | fliH | b1940 | flagellar biosynthesis; export of flagellar proteins |
| MDS28 | CDS | 2014578 . . . 2015951 | fliI | b1941 | flagellum-specific ATP synthase |
| MDS28 | CDS | 2015970 . . . 2016413 | fliJ | b1942 | flagellar fliJ protein |
| MDS28 | CDS | 2016410 . . . 2017537 | fliK | b1943 | flagellar hook-length control protein |
| MDS28 | CDS | 2017642 . . . 2018106 | fliL | b1944 | flagellar biosynthesis |
| MDS28 | CDS | 2018111 . . . 2019115 | fliM | b1945 | flagellar biosynthesis, component of motor switch and energizing, enabling rotation and determining its direction |
| MDS28 | CDS | 2019112 . . . 2019525 | fliN | b1946 | flagellar biosynthesis, component of motor switch and energizing, enabling rotation and determining its direction |
| MDS28 | CDS | 2019588 . . . 2019893 | fliO | b1947 | flagellar biosynthesis |
| MDS28 | CDS | 2019893 . . . 2020630 | fliP | b1948 | flagellar biosynthesis |
| MDS28 | CDS | 2020640 . . . 2020909 | fliQ | b1949 | flagellar biosynthesis |
| MDS28 | CDS | 2020917 . . . 2021702 | fliR | b1950 | flagellar biosynthesis |
| MDS29 | CDS | 4552599 . . . 4553372 | uxuR | b4324 | regulator for uxu operon |
| MDS29 | CDS | complement(4553513 . . . 4554343) | yjiC | b4325 | orf, hypothetical protein |
| MDS29 | CDS | 4555007 . . . 4555408 | yjiD | b4326 | orf, hypothetical protein |
| MDS29 | CDS | complement(4555401 . . . 4556312) | yjiE | b4327 | putative transcriptional regulator LYSR-type |
| MDS29 | CDS | complement(4556377 . . . 4557549) | iadA | b4328 | isoaspartyl dipeptidase |
| MDS29 | CDS | complement(4557562 . . . 4558023) | yjiG | b4329 | orf, hypothetical protein |
| MDS29 | CDS | complement(4558020 . . . 4558715) | yjiH | b4330 | orf, hypothetical protein |
| MDS29 | CDS | 4558851 . . . 4559507 | yjiI | b4331 | orf, hypothetical protein |
| MDS29 | CDS | complement(4559520 . . . 4560698) | yjiJ | b4332 | putative transport protein |
| MDS29 | CDS | complement(4560766 . . . 4561737) | yjiK | b4333 | orf, hypothetical protein |
| MDS29 | CDS | complement(4561945 . . . 4562718) | yjiL | b4334 | putative enzyme |
| MDS29 | CDS | complement(4562722 . . . 4563894) | yjiM | b4335 | orf, hypothetical protein |
| MDS29 | CDS | complement(4563989 . . . 4565269) | yjiN | b4336 | orf, hypothetical protein |
| MDS29 | CDS | complement(4565310 . . . 4566542) | yjiO | b4337 | putative transport protein |
| MDS29 | CDS | 4567021 . . . 4567332 | yjiP | b4338 | orf, hypothetical protein |

TABLE 2-continued

| Strain | Type | Coordinates | Name | B | Function |
|---|---|---|---|---|---|
| MDS29 | CDS | 4567381 ... 4567941 | yjiQ | b4339 | orf, hypothetical protein |
| MDS29 | CDS | complement(4568185 ... 4569597) | yjiR | b4340 | putative regulator |
| MDS29 | CDS | 4569774 ... 4569938 | yjiS | b4341 | orf, hypothetical protein |
| MDS29 | CDS | 4570389 ... 4571954 | yjiT | b4342 | orf, hypothetical protein |
| MDS29 | CDS | complement(4574935 ... 4575981) | mcrC | b4345 | component of McrBC 5-methylcytosine restriction system |
| MDS29 | CDS | complement(4575981 ... 4577378) | mcrB | b4346 | component of McrBC 5-methylcytosine restriction system |
| MDS29 | CDS | complement(4577522 ... 4577920) | yjiW | b4347 | orf, hypothetical protein |
| MDS29 | CDS | complement(4578091 ... 4579485) | hsdS | b4348 | specificity determinant for hsdM and hsdR |
| MDS29 | CDS | complement(4579482 ... 4581071) | hsdM | b4349 | host modification; DNA methylase M |
| MDS29 | CDS | complement(4581272 ... 4584838) | hsdR | b4350 | host restriction; endonuclease R |
| MDS29 | CDS | 4584972 ... 4585886 | mrr | b4351 | restriction of methylated adenine |
| MDS29 | CDS | complement(4585932 ... 4586786) | yjiA | b4352 | orf, hypothetical protein |
| MDS29 | CDS | complement(4586899 ... 4587102) | yjiX | b4353 | orf, hypothetical protein |
| MDS29 | CDS | complement(4587152 ... 4589317) | yjiY | b4354 | putative carbon starvation protein |
| MDS29 | CDS | 4589680 ... 4591335 | tsr | b4355 | methyl-accepting chemotaxis protein I serine sensor receptor |
| MDS29 | CDS | complement(4591384 ... 4592745) | yjiZ | b4356 | putative transport protein, cryptic orf, joins former yjiZ and yjjL |
| MDS29 | CDS | complement(4592960 ... 4593874) | yjjM | b4357 | orf, hypothetical protein |
| MDS29 | CDS | 4593998 ... 4595035 | yjjN | b4358 | putative oxidoreductase |
| MDS29 | CDS | 4572158 ... 4574878 | yjiV | b4486 | conserved hypothetical protein |
| MDS30 | CDS | 522485 ... 526765 | rhsD | b0497 | rhsD protein in rhs element |
| MDS30 | CDS | 526805 ... 527173 | | b0498 | orf, hypothetical protein |
| MDS30 | CDS | 527173 ... 527883 | | b0499 | orf, hypothetical protein |
| MDS30 | CDS | 527864 ... 528124 | ybbD | b0500 | orf, hypothetical protein |
| MDS30 | CDS | 528163 ... 528354 | | b0501 | orf, hypothetical protein |
| MDS30 | CDS | complement(528869 ... 529276) | | b0502 | orf, hypothetical protein |
| MDS31 | CDS | 728806 ... 732999 | rhsC | b0700 | |
| MDS31 | CDS | 732593 ... 732814 | | b0701 | |
| MDS31 | CDS | 732999 ... 733325 | ybfB | b0702 | orf, hypothetical protein |
| MDS31 | CDS | 733443 ... 734876 | | b0703 | orf, hypothetical protein |
| MDS31 | CDS | 734873 ... 735442 | ybfC | b0704 | orf, hypothetical protein |
| MDS31 | CDS | 736327 ... 737184 | ybfL | b0705 | putative receptor protein |
| MDS31 | CDS | 737315 ... 738076 | ybfD | b0706 | putative DNA ligase |
| MDS32 | CDS | 1525914 ... 1527962 | rhsE | b1456 | |
| MDS32 | CDS | 1527946 ... 1528428 | ydcD | b1457 | orf, hypothetical protein |
| MDS32 | CDS | 1528610 ... 1529356 | | b1458 | orf, hypothetical protein |
| MDS32 | CDS | 1529400 ... 1529600 | | b1459 | orf, hypothetical protein |
| MDS32 | CDS | 1529840 ... 1530976 | ydcC | b1460 | H repeat-associated protein (ORF-H) |
| MDS32 | CDS | 1531076 ... 1531309 | ydcE | b1461 | orf, hypothetical protein |
| MDS32 | CDS | complement(1531306 ... 1531923) | | b1462 | orf, hypothetical protein |
| MDS33 | CDS | 3616611 ... 3617012 | yhhG | b3481 | |
| MDS33 | CDS | 3617215 ... 3621450 | rhsB | b3482 | rhsB protein in rhs element |
| MDS33 | CDS | 3621437 ... 3621805 | yhhH | b3483 | orf, hypothetical protein |
| MDS33 | CDS | 3622401 ... 3623537 | yhhI | b3484 | putative receptor |
| MDS34 | CDS | complement(3759370 ... 3759978) | yibF | b3592 | putative S-transferase |
| MDS34 | CDS | 3760206 ... 3764339 | rhsA | b3593 | rhsA protein in rhs element |
| MDS34 | CDS | 3764360 ... 3765202 | yibA | b3594 | orf, hypothetical protein |
| MDS34 | CDS | 3765244 ... 3765945 | yibJ | b3595 | orf, hypothetical protein |
| MDS34 | CDS | 3766200 ... 3766661 | yibG | b3596 | orf, hypothetical protein |
| MDS35 | CDS | complement(1041253 ... 1043433) | yccC | b0981 | orf, hypothetical protein |
| MDS35 | CDS | complement(1043453 ... 1043911) | yccY | b0982 | yccY putative phosphatase |
| MDS35 | CDS | complement(1043887 ... 1045026) | yccZ | b0983 | putative function in exopolysaccharide production |
| MDS35 | CDS | complement(1045072 ... 1047168) | ymcA | b0984 | orf, hypothetical protein |
| MDS35 | CDS | complement(1047168 ... 1047914) | ymcB | b0985 | orf, hypothetical protein |
| MDS35 | CDS | complement(1047911 ... 1048555) | ymcC | b0986 | putative regulator |
| MDS35 | CDS | complement(1048662 ... 1048985) | ymcD | b0987 | orf, hypothetical protein |
| MDS35 | CDS | 1049250 ... 1049753 | insB_4 | b0988 | IS1 protein InsB |
| MDS36 | CDS | complement(1085329 ... 1085742) | ycdP | b1021 | orf, hypothetical protein |
| MDS36 | CDS | complement(1085744 ... 1087069) | ycdQ | b1022 | orf, hypothetical protein |
| MDS36 | CDS | complement(1087062 ... 1089080) | ycdR | b1023 | orf, hypothetical protein |
| MDS36 | CDS | complement(1089089 ... 1091512) | ycdS | b1024 | putative outer membrane protein |
| MDS36 | CDS | 1092099 ... 1093457 | ycdT | b1025 | orf, hypothetical protein |
| MDS36 | CDS | complement(1093498 ... 1094364) | tra5_3 | b1026 | |
| MDS36 | CDS | complement(1094361 ... 1094669) | | b1027 | |
| MDS36 | CDS | 1094746 ... 1095069 | | b1028 | orf, hypothetical protein |
| MDS36 | CDS | 1095066 ... 1096052 | ycdU | b1029 | orf, hypothetical protein |
| MDS37 | CDS | 2163174 ... 2163545 | | b2080 | orf, hypothetical protein |
| MDS37 | CDS | 2163692 ... 2165053 | yegQ | b2081 | orf, hypothetical protein |
| MDS37 | CDS | complement(2165326 ... 2165544) | ogrK | b2082 | prophage P2 ogr protein |
| MDS37 | CDS | complement(2165626 ... 2165772) | | b2083 | orf, hypothetical protein |
| MDS37 | CDS | complement(2165759 ... 2166025) | | b2084 | orf, hypothetical protein |
| MDS37 | CDS | complement(2166013 ... 2166390) | yegR | b2085 | orf, hypothetical protein |
| MDS37 | CDS | 2166736 ... 2167635 | | b2086 | orf, hypothetical protein |

TABLE 2-continued

| Strain | Type | Coordinates | Name | B | Function |
|---|---|---|---|---|---|
| MDS37 | CDS | complement(2167717 . . . 2168163) | gatR_1 | b2087 | split galactitol utilization operon repressor |
| MDS37 | CDS | 2168251 . . . 2168559 | | b2088 | |
| MDS37 | CDS | 2168556 . . . 2169422 | tra5_4 | b2089 | |
| MDS37 | CDS | complement(2169419 . . . 2169757) | gatR_2 | b2090 | |
| MDS37 | CDS | complement(2169857 . . . 2170897) | gatD | b2091 | galactitol-1-phosphate dehydrogenase |
| MDS37 | CDS | complement(2170945 . . . 2172300) | gatC | b2092 | PTS system galactitol-specific enzyme IIC |
| MDS37 | CDS | complement(2172304 . . . 2172588) | gatB | b2093 | galactitol-specific enzyme IIB of phosphotransferase system |
| MDS37 | CDS | complement(2172619 . . . 2173071) | gatA | b2094 | galactitol-specific enzyme IIA of phosphotransferase system |
| MDS37 | CDS | complement(2173081 . . . 2174343) | gatZ | b2095 | putative tagatose 6-phosphate kinase 1 |
| MDS37 | CDS | complement(2174372 . . . 2175232) | gatY | b2096 | tagatose-bisphosphate aldolase 1 |
| MDS37 | misc_RNA | 2165136 . . . 2165221 | ryeE | b4438 | |
| MDS38 | CDS | complement(3577791 . . . 3578828) | yhhX | b3440 | putative regulator |
| MDS38 | CDS | 3579161 . . . 3579649 | yhhY | b3441 | orf, hypothetical protein |
| MDS38 | CDS | 3579886 . . . 3581064 | yhhZ | b3442 | orf, hypothetical protein |
| MDS38 | CDS | 3581061 . . . 3581477 | yrhA | b3443 | orf, hypothetical protein |
| MDS38 | CDS | 3581506 . . . 3581781 | insA_6 | b3444 | IS1 protein InsA |
| MDS38 | CDS | 3581700 . . . 3582203 | insB_6 | b3445 | IS1 protein InsB |
| MDS38 | misc_RNA | complement(3578946 . . . 3579039) | ryhB | b4451 | regulatory RNA mediating Fur regulon |
| MDS39 | CDS | 3718072 . . . 3718284 | cspA | b3556 | cold shock protein 7.4, transcriptional activator of hns |
| MDS39 | CDS | 3718703 . . . 3719224 | yi5A | b3557 | IS150 hypothetical protein |
| MDS39 | CDS | 3719221 . . . 3720072 | t150 | b3558 | IS150 putative transposase |
| MDS39 | CDS | complement(3718471 . . . 3718623) | hokA | b4455 | small toxic membrane polypeptide |
| MDS40 | CDS | 1869885 . . . 1871555 | yeaJ | b1786 | orf, hypothetical protein |
| MDS41 | CDS | 167484 . . . 169727 | fhuA | b0150 | outer membrane protein receptor for ferrichrome, colicin M, and phages T1, T5, and phi80 |
| MDS41 | CDS | 169778 . . . 170575 | fhuC | b0151 | ATP-binding component of hydroxymate-dependent iron transport |
| MDS41 | CDS | 170575 . . . 171465 | fhuD | b0152 | hydroxamate-dependent iron uptake cytoplasmic membrane component |
| MDS41 | CDS | 171462 . . . 173444 | fhuB | b0153 | hydroxamate-dependent iron uptake cytoplasmic membrane component |

TABLE 3

| Strain | Type | Coordinates | Name | B | Function |
|---|---|---|---|---|---|
| MDS43 | CDS | 331595 . . . 332683 | yahA | b0315 | orf, hypothetical protein |
| MDS43 | CDS | complement(332725 . . . 333657) | yahB | b0316 | putative transcriptional regulator LYSR-type |
| MDS43 | CDS | complement(333749 . . . 334246) | yahC | b0317 | orf, hypothetical protein |
| MDS43 | CDS | 334504 . . . 335109 | yahD | b0318 | putative transcription factor |
| MDS43 | CDS | 335149 . . . 336012 | yahE | b0319 | orf, hypothetical protein |
| MDS43 | CDS | 336002 . . . 337549 | yahF | b0320 | putative oxidoreductase subunit |
| MDS43 | CDS | 337549 . . . 338967 | yahG | b0321 | orf, hypothetical protein |
| MDS43 | CDS | 339389 . . . 340339 | yahI | b0323 | putative kinase (EC 2.7.2.2 |
| MDS43 | CDS | 340349 . . . 341731 | yahJ | b0324 | putative deaminase |
| MDS43 | CDS | 342108 . . . 343157 | yahK | b0325 | putative oxidoreductase |
| MDS43 | CDS | 343400 . . . 344215 | yahL | b0326 | orf, hypothetical protein |
| MDS43 | CDS | 344598 . . . 344873 | yahM | b0327 | orf, hypothetical protein |
| MDS43 | CDS | complement(344890 . . . 345561) | yahN | b0328 | putative cytochrome subunit of dehydrogenase |
| MDS43 | CDS | 345708 . . . 345983 | yahO | b0329 | orf, hypothetical protein |
| MDS43 | CDS | complement(346081 . . . 347667) | prpR | b0330 | regulator for prp operon |
| MDS43 | CDS | 347906 . . . 348796 | prpB | b0331 | putative phosphonomutase 2 |
| MDS43 | CDS | 349236 . . . 350405 | prpC | b0333 | putative citrate synthase; propionate metabolism |
| MDS43 | CDS | 350439 . . . 351890 | prpD | b0334 | orf, hypothetical protein |
| MDS43 | CDS | 351930 . . . 353816 | prpE | b0335 | putative propionyl-CoA synthetase |
| MDS43 | CDS | 354146 . . . 355405 | codB | b0336 | cytosine permease/transport |
| MDS43 | CDS | 355395 . . . 356678 | codA | b0337 | cytosine deaminase |
| MDS43 | CDS | complement(357015 . . . 357914) | cynR | b0338 | cyn operon positive regulator |
| MDS43 | CDS | 358023 . . . 358682 | cynT | b0339 | carbonic anhydrase |
| MDS43 | CDS | 358713 . . . 359183 | cynS | b0340 | cyanate aminohydrolase, cyanase |
| MDS43 | CDS | 359216 . . . 360370 | cynX | b0341 | cyanate transport |
| MDS43 | CDS | complement(360473 . . . 361084) | lacA | b0342 | thiogalactoside acetyltransferase |
| MDS43 | CDS | complement(361150 . . . 362403) | lacY | b0343 | galactoside permease (lactose permease M protein) (MFS family) |
| MDS43 | CDS | complement(362455 . . . 365529) | lacZ | b0344 | beta-D-galactosidase |

TABLE 3-continued

| Strain | Type | Coordinates | Name | B | Function |
|---|---|---|---|---|---|
| MDS43 | CDS | complement(365652 . . . 366734) | lacI | b0345 | transcriptional repressor of the lac operon |
| MDS43 | CDS | complement(366811 . . . 367758) | mhpR | b0346 | transcriptional regulator for mhp operon |
| MDS43 | CDS | 367835 . . . 369499 | mhpA | b0347 | 3-(3-hydroxyphenyl)propionate hydroxylase |
| MDS43 | CDS | 369501 . . . 370445 | mhpB | b0348 | 2,3-dihydroxyphenylpropionate 1,2-dioxygenase |
| MDS43 | CDS | 370400 . . . 371329 | mhpC | b0349 | 2-hydroxy-6-ketonona-2,4-dienedioic acid hydrolase |
| MDS43 | CDS | 371333 . . . 372148 | mhpD | b0350 | 2-keto-4-pentenoate hydratase |
| MDS43 | CDS | 372145 . . . 373095 | mhpF | b0351 | acetaldehyde dehydrogenase |
| MDS43 | CDS | 373092 . . . 374105 | mhpE | b0352 | 4-hydroxy-2-ketovalerate aldolase |
| MDS43 | CDS | 374638 . . . 375894 | mhpT | b0353 | 2,3-dihydroxyphenylpropionate 1,2-dioxygenase |
| MDS43 | CDS | 375879 . . . 376535 | yaiL | b0354 | nucleoprotein/polynucleotide-associated enzyme |

TABLE 4

| Strain | Type | Coordinates | Name | B | Function |
|---|---|---|---|---|---|
| MDS44 | CDS | 2599223 . . . 2599840 | hyfA | b2481 | hydrogenase 4 Fe—S subunit |
| MDS44 | CDS | 2599840 . . . 2601858 | hyfB | b2482 | hydrogenase 4 membrane subunit |
| MDS44 | CDS | 2601869 . . . 2602816 | hyfC | b2483 | hydrogenase 4 membrane subunit |
| MDS44 | CDS | 2602833 . . . 2604272 | hyfD | b2484 | hydrogenase 4 membrane subunit |
| MDS44 | CDS | 2604284 . . . 2604934 | hyfE | b2485 | hydrogenase 4 membrane subunit |
| MDS44 | CDS | 2604939 . . . 2606519 | hyfF | b2486 | hydrogenase 4 membrane subunit |
| MDS44 | CDS | 2606509 . . . 2608176 | hyfG | b2487 | hydrogenase 4 subunit |
| MDS44 | CDS | 2608186 . . . 2608731 | hyfH | b2488 | hydrogenase 4 Fe—S subunit |
| MDS44 | CDS | 2608728 . . . 2609486 | hyfI | b2489 | hydrogenase 4 Fe—S subunit |
| MDS44 | CDS | 2609479 . . . 2609892 | hyfJ | b2490 | hydrogenase 4 component J |
| MDS44 | CDS | 2609922 . . . 2611934 | hyfR | b2491 | putative 2-component regulator interaction with sigma 54 |
| MDS44 | CDS | 2611956 . . . 2612804 | focB | b2492 | probable formate transporter (formate channel 2) |

TABLE 5

| Strain | Type | Coordinates | Name | B | Function |
|---|---|---|---|---|---|
| MDS45 | CDS | 2318065 . . . 2319891 | atoS | b2219 | sensor protein AtoS for response regulator AtoC |
| MDS45 | CDS | 2319888 . . . 2321273 | atoC | b2220 | response regulator of ato, ornithine decarboxylase antizyme (sensor ATOS) |
| MDS45 | CDS | 2321469 . . . 2322131 | atoD | b2221 | acetyl-CoA:acetoacetyl-CoA transferase alpha subunit |
| MDS45 | CDS | 2322131 . . . 2322781 | atoA | b2222 | acetyl-CoA:acetoacetyl-CoA transferase beta subunit |
| MDS45 | CDS | 2322778 . . . 2324100 | atoE | b2223 | short chain fatty acid transporter |
| MDS45 | CDS | 2324131 . . . 2325315 | atoB | b2224 | acetyl-CoA acetyltransferase |
| MDS45 | CDS | complement(2325389 . . . 2326165) | yfaP | b2225 | orf, hypothetical protein |
| MDS45 | CDS | complement(2326170 . . . 2327819) | yfaQ | b2226 | orf, hypothetical protein |
| MDS45 | CDS | complement(2327820 . . . 2328305) | yfaS_2 | b2227 | orf, hypothetical protein |
| MDS45 | pseudogene | complement(2327820 . . . 2332424) | yfaS | b4500 | pseudogene |
| MDS45 | CDS | complement(2328321 . . . 2332424) | yfaS_1 | b2228 | putative membrane protein |
| MDS45 | CDS | complement(2332358 . . . 2332981) | yfaT | b2229 | orf, hypothetical protein |
| MDS45 | CDS | complement(2332978 . . . 2334666) | yfaA | b2230 | orf, hypothetical protein |

TABLE 6

| Strain | Type | Coordinates | Name | B | Function |
|---|---|---|---|---|---|
| MDS46 | CDS | 3886458...3886532 | tnaL | b3707 | tryptophanase leader peptide |
| MDS46 | CDS | 3886753...3888168 | tnaA | b3708 | tryptophanase |
| MDS46 | CDS | 3888259...3889506 | tnaB | b3709 | low affinity tryptophan permease |
| MDS46 | CDS | 3889638...3890813 | yidY | b3710 | putative transport protein |
| MDS46 | CDS | 3890788...3891747 | yidZ | b3711 | putative transcriptional regulator LYSR-type |
| MDS46 | CDS | 3891892...3892653 | yieE | b3712 | orf, hypothetical protein |
| MDS46 | CDS | 3892675...3893241 | yieF | b3713 | orf, hypothetical protein |
| MDS46 | CDS | complement(3893295...3894632) | yieG | b3714 | putative membrane/transport protein |
| MDS46 | CDS | 3894797...3895462 | yieH | b3715 | putative phosphatase |
| MDS46 | CDS | 3895529...3895996 | yieI | b3716 | orf, hypothetical protein |
| MDS46 | CDS | 3896045...3896632 | yieJ | b3717 | orf, hypothetical protein |
| MDS46 | CDS | complement(3896694...3897416) | yieK | b3718 | pyrimidine-specific nucleoside hydrolase |
| MDS46 | CDS | complement(3897431...3898627) | yieL | b3719 | putative xylanase |
| MDS46 | CDS | complement(3898627...3900243) | yieC | b3720 | putative receptor protein |
| MDS46 | CDS | complement(3900312...3901724) | bglB | b3721 | phospho-beta-glucosidase B; cryptic |
| MDS46 | CDS | complement(3901743...3903620) | bglF | b3722 | PTS system beta-glucosides, enzyme II, cryptic |
| MDS46 | CDS | complement(3903754...3904590) | bglG | b3723 | positive regulation of bgl operon |

TABLE 7

| Strain | Type | Coordinates | Name | B | Function |
|---|---|---|---|---|---|
| MDS47 | CDS | complement(674793...675770) | ybeQ | b0644 | orf, hypothetical protein |
| MDS47 | CDS | 675934...676641 | ybeR | b0645 | orf, hypothetical protein |
| MDS47 | CDS | 676638...678065 | ybeS | b0646 | putative enzyme of polynucleotide modification |
| MDS47 | CDS | complement(678075...678629) | ybeT | b0647 | orf, hypothetical protein |
| MDS47 | CDS | 678731...679438 | ybeU | b0648 | putative tRNA ligase |
| MDS47 | CDS | 679435...680886 | ybeV | b0649 | orf, hypothetical protein |
| MDS47 | CDS | complement(680946...682616) | hscC | b0650 | putative heatshock protein (Hsp70 family) |

TABLE 8

| Strain | Type | Coordinates | Name | B | Function |
|---|---|---|---|---|---|
| MDS48 | CDS | complement(4295242...4297389) | fdhF | b4079 | selenopolypeptide subunit of formate dehydrogenase H |
| MDS48 | CDS | complement(4297587...4299053) | yjcP | b4080 | putative enzyme |
| MDS48 | CDS | complement(4299050...4301101) | yjcQ | b4081 | putative enzyme |
| MDS48 | CDS | complement(4301101...4302132) | yjcR | b4082 | putative membrane protein |
| MDS48 | CDS | complement(4302635...4304620) | yjcS | b4083 | orf, hypothetical protein |
| MDS48 | CDS | complement(4304893...4305822) | alsK | b4084 | putative D-allose kinase |
| MDS48 | CDS | complement(4305806...4306501) | alsE | b4085 | allulose-6-phosphate 3-epimerase |
| MDS48 | CDS | complement(4306512...4307492) | alsF | b4086 | D-allose ABC transporter |
| MDS48 | CDS | complement(4307471...4309003) | alsA | b4087 | D-allose ABC transporter |
| MDS48 | CDS | complement(4309130...4310065) | alsB | b4088 | D-allose ABC transporter |
| MDS48 | CDS | complement(4310124...4311014) | rpiR | b4089 | transcriptional repressor of rpiB expression |
| MDS48 | CDS | 4311373...4311822 | rpiB | b4090 | ribose 5-phosphate isomerase B |
| MDS48 | CDS | 4311891...4312220 | yjdP | b4487 | conserved hypothetical protein |
| MDS48 | CDS | complement(4312367...4313125) | phnP | b4092 | phosphonate metabolism |
| MDS48 | CDS | complement(4313127...4313561) | phnO | b4093 | putative regulator, phn operon |
| MDS48 | CDS | complement(4313548...4314105) | phnN | b4094 | ATP-binding component of phosphonate transport |
| MDS48 | CDS | complement(4314105...4315241) | phnM | b4095 | phosphonate metabolism |
| MDS48 | CDS | complement(4315238...4315918) | phnL | b4096 | ATP-binding component of phosphonate transport |
| MDS48 | CDS | complement(4316029...4316787) | phnK | b4097 | ATP-binding component of phosphonate transport |
| MDS48 | CDS | complement(4316784...4317629) | phnJ | b4098 | phosphonate metabolism |
| MDS48 | CDS | complement(4317622...4318686) | phnI | b4099 | phosphonate metabolism |
| MDS48 | CDS | complement(4318686...4319270) | phnH | b4100 | phosphonate metabolism |
| MDS48 | CDS | complement(4319267...4319719) | phnG | b4101 | phosphonate metabolism |
| MDS48 | CDS | complement(4319720...4320445) | phnF | b4102 | putative transcriptional regulator |
| MDS48 | CDS | complement(4320466...4320834) | phnE_2 | b4103 | orf, hypothetical protein |
| MDS48 | CDS | complement(4320684...4321304) | phnE | b4104 | membrane channel protein component of Pn transporter |

TABLE 8-continued

| Strain | Type | Coordinates | Name | B | Function |
|---|---|---|---|---|---|
| MDS48 | CDS | complement(4321359 ... 4322375) | phnD | b4105 | periplasmic binding protein component of Pn transporter |
| MDS48 | CDS | complement(4322400 ... 4323188) | phnC | b4106 | ATP-binding component of phosphonate transport |

TABLE 9

| Strain | Type | Coordinates | Name | B | Function |
|---|---|---|---|---|---|
| MDS49 | CDS | complement(764376 ... 765098) | farR | b0730 | transcriptional regulator of succinyl-CoA synthetase operon |
| MDS49 | CDS | 765207 ... 767183 | hrsA | b0731 | protein modification enzyme, induction of ompC |
| MDS49 | CDS | 767201 ... 769834 | ybgG | b0732 | putative sugar hydrolase |

TABLE 10

| Strain | Type | Coordinates | Name | B | Function |
|---|---|---|---|---|---|
| MDS50 | CDS | 3737728 ... 3738981 | avtA | b3572 | alanine-alpha-ketoisovalerate (or valine-pyruvate) transaminase, transaminase C |
| MDS50 | CDS | complement(3739132 ... 3739605) | yiaI | b3573 | orf, hypothetical protein |
| MDS50 | CDS | complement(3739707 ... 3740555) | yiaJ | b3574 | transcriptional repressor of the yiaK-S operon. |
| MDS50 | CDS | 3740756 ... 3741754 | yiaK | b3575 | putative dehydrogenase |
| MDS50 | CDS | 3741766 ... 3742233 | yiaL | b3576 | putative lipase |
| MDS50 | CDS | 3742351 ... 3742824 | yiaM | b3577 | orf, hypothetical protein |
| MDS50 | CDS | 3742827 ... 3744104 | yiaN | b3578 | putative membrane protein |
| MDS50 | CDS | 3744117 ... 3745103 | yiaO | b3579 | putative solute-binding transport protein |
| MDS50 | CDS | 3745107 ... 3746603 | lyxK | b3580 | L-xylulose kinase, cryptic |
| MDS50 | CDS | 3746600 ... 3747262 | sgbH | b3581 | probable 3-hexulose 6-phosphate synthase |
| MDS50 | CDS | 3747255 ... 3748115 | sgbU | b3582 | putative 3-hexulose-6-phosphate isomerase |
| MDS50 | CDS | 3748109 ... 3748804 | sgbE | b3583 | L-ribulose-5-phosphate 4-epimerase |
| MDS50 | CDS | complement(3749151 ... 3749891) | yiaT | b3584 | putative outer membrane protein |
| MDS50 | CDS | 3750015 ... 3750989 | yiaU | b3585 | putative transcriptional regulator LYSR-type |
| MDS50 | CDS | complement(3750986 ... 3752122) | yiaV | b3586 | putative membrane protein |
| MDS50 | CDS | complement(3752128 ... 3752451) | yiaW | b3587 | orf, hypothetical protein |

TABLE 11

| Strain | Type | Coordinates | Name | B | Function |
|---|---|---|---|---|---|
| MDS51 | CDS | 1727111 ... 1731727 | lhr | b1653 | member of ATP-dependent helicase superfamily II |

TABLE 12

| Strain | Type | Coordinates | Name | B | Function |
|---|---|---|---|---|---|
| MD52 | CDS | complement(2858489 ... 2859286) | ygbI | b2735 | putative DEOR-type transcriptional regulator |
| MD52 | CDS | 2859452 ... 2860360 | ygbJ | b2736 | putative dehydrogenase |
| MD52 | CDS | 2860357 ... 2861523 | ygbK | b2737 | orf, hypothetical protein |
| MD52 | CDS | 2861615 ... 2862253 | ygbL | b2738 | putative epimerase/aldolase |
| MD52 | CDS | 2862258 ... 2863034 | ygbM | b2739 | orf, hypothetical protein |
| MD52 | CDS | 2863123 ... 2864487 | ygbN | b2740 | putative transport protein |

TABLE 13

| Strain | Type | Coordinates | Name | B | Function |
|---|---|---|---|---|---|
| MDS53 | CDS | complement(2519615 ... 2520499) | xapR | b2405 | regulator for xapA |
| MDS53 | CDS | complement(2520751 ... 2522007) | xapB | b2406 | xanthosine permease |
| MDS53 | CDS | complement(2522067 ... 2522900) | xapA | b2407 | xanthosine phosphorylase |

TABLE 14

| Strain | Type | Coordinates | Name | B | Function |
|---|---|---|---|---|---|
| MDS54 | CDS | 4085025 ... 4086080 | yiiG | b3896 | orf, hypothetical protein |
| MDS54 | CDS | complement(4086130 ... 4087878) | frvR | b3897 | putative frv operon regulatory protein |
| MDS54 | CDS | complement(4087878 ... 4088948) | frvX | b3898 | frv operon protein |
| M0S54 | CDS | complement(4088938 ... 4090389) | frvB | b3899 | PTS system, fructose-like enzyme IIBC component |
| MDS54 | CDS | complement(4090400 ... 4090846) | frvA | b3900 | PTS system, fructose-specific IIA component |

TABLE 15

| Strain | Type | Coordinates | Name | B | Function |
|---|---|---|---|---|---|
| MDS55 | CDS | complement(1252308 ... 1255175) | yogV | b1202 | putative adhesion and penetration protein |

TABLE 16

| Strain | Type | Coordinates | Name | B | Function |
|---|---|---|---|---|---|
| MDS56 | CDS | complement(4486584 ... 4488086) | yigR | b4263 | orf, hypothetical protein |
| MDS56 | CDS | complement(4488164 ... 4489162) | idnR | b4264 | L-idonate transcriptional regulator |
| MDS56 | CDS | complement(4489229 ... 4490548) | idnT | b4265 | L-idonate transporter |
| MDS56 | CDS | complement(4490610 ... 4491374) | idnO | b4266 | 5-keto-D-gluconate 5-reductase |
| MDS56 | CDS | complement(4491398 ... 4492429) | idnD | b4267 | L-idonate dehydrogenase |
| MDS56 | CDS | 4492646 ... 4493209 | idnK | b4268 | gluconate kinase |

TABLE 17

| Strain | Type | Coordinates | Name | B | Function |
|---|---|---|---|---|---|
| MDS57 | CDS | complement(643420 ... 644226) | rna | b0611 | RNase I, cleaves phosphodiester bond between any two nucleotides |

TABLE 18

| Strain | Type | Coordinates | Name | B | Function |
|---|---|---|---|---|---|
| MDS58 | CDS | complement(2474716 ... 2475651) | dsdC | b2364 | D-serine dehydratase (deaminase) transcriptional activator |
| MDS58 | CDS | 2475869 ... 2477206 | dsdX | b2365 | transport system permease (serine) |
| MDS58 | CDS | 2477224 ... 2478552 | dsdA | b2366 | D-serine dehydratase (deaminase) |

TABLE 19

| Strain | Type | Coordinates | Name | B | Function |
|---|---|---|---|---|---|
| MDS59 | CDS | 879950...881152 | dacC | b0839 | D-alanyl-D-alanine carboxypeptidase penicillin-binding protein 6 |

TABLE 20

| Strain | Type | Coordinates | Name | B | Function |
|---|---|---|---|---|---|
| MDS60 | CDS | complement(513625...514080) | ybbJ | b0488 | orf, hypothetical protein |
| MDS60 | CDS | complement(514080...514997) | ybbK | b0489 | putative protease |
| MDS60 | CDS | 515143...515820 | ybbL | b0490 | putative ATP-binding component of a transport system |
| MDS60 | CDS | 515807...516586 | ybbM | b0491 | putative metal resistance protein |
| MDS60 | CDS | complement(516649...517503) | ybbN | b0492 | putative thioredoxin-like protein |
| MDS60 | CDS | complement(517564...518373) | ybbO | b0493 | putative oxidoreductase |
| MDS60 | CDS | complement(518363...518989) | tesA | b0494 | acyl-CoA thioesterase I; also functions as protease I |
| MDS60 | CDS | 518957...519643 | ybbA | b0495 | putative ATP-binding component of a transport system |
| MDS60 | CDS | 519640...522054 | ybbP | b0496 | putative oxidoreductase |
| MDS60 | CDS | 522485...526765 | rhsD | b0497 | rhsD protein in rhs element |
| MDS60 | CDS | 526805...527173 | ybbC | b0498 | orf, hypothetical protein |
| MDS60 | CDS | 527173...527883 | ylbH | b0499 | orf, hypothetical protein |
| MDS60 | CDS | 527864...528124 | ybbD | b0500 | orf, hypothetical protein |
| MDS60 | CDS | complement(528869...529240) | ylbJ | b0502 | orf, hypothetical protein |

SEQUENCE LISTING (1 sequence)

SEQ ID NO: 1 - DNA, 4639675 bp, Escherichia coli (residues 1-1,546,559 of 4,639,675)
agcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggctttttttttcgaccaaaggtaacgaggtaacaaccatgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaaatgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaaaatctattcattatctcaatcaggccgggtttgcttttatgcagcccggcttttttatgaagaaattatggagaaaaatgacagggaaaaaggagaaattctcaataaatgcggtaacttagagattaggattgcggagaataacaaccgccgttctcatcgagtaatctccggatatcgacccataacgggcaatgataaaaggagtaacctgtgaaaaagatgcaatctatcgtactcgcactttccctggttctggtcgctcccatggcagcacaggctgcggaaattacgttagtcccgtcagtaaaattacagataggcgatcgtgataatcgtggctattactgggatggaggtcactggcgcgaccacggctggtggaaacaacattatgaatggcgaggcaatcgctggcacctacacggaccgccgccaccgccgcgccaccataagaaagctcctcatgatcatcacggcggtcatggtccaggcaaacatcaccgctaaatgacaaatgccgggtaacaatccggcattcagcgcctgatgcgacgctggcgcgtcttatcaggcctacgttaattctgcaatatattgaatctgcatgcttttgtaggcaggataaggcgttcacgccgcatccggcattgactgcaaacttaacgctgctcgtagcgtttaaacaccagttcgccattgctggaggaatcttcatcaaagaagtaaccttcgctattaaaaccagtcagttgctctggtttggtcagccgattttcaataatgaaacgactcatcagaccgcgtgctttcttagcgtagaagctgatgatcttaaatttgccgttcttctcatcgaggaacaccggcttgataatctcggcattcaatttcttcggcttcaccgatttaaaatactcatctgacgccagattaatcaccacattatcgccttgtgctgcgagcgcctcgttcagcttgttggtgatgatatctccccagaattgatacagatctttccctcgggcattctcaagacggatccccatttccagacgataaggctgcattaaatcgagcgggcggagtacgccatacaagccggaaagcattcgcaaatgctgttgggcaaaatcgaaatcgtcttcgctgaaggtttcggcctgcaagccggtgtagacatcacctttaaacgccagaatcgcctggcgggcattcgccggcgtgaaatctggctgccagtcatgaaagcgagcggcgttgatacccgccagtttgtcgctgatgcgcatcagcgtgctaatctgcggaggcgtcagtttccgcgcctcatggatcaactgctgggaattgtctaacagctccggcagcgtatagcgcgtggtggtcaacgggctttggtaatcaagcgttttcgcaggtgaaataagaatcagcatatccagtccttgcaggaaatttatgccgactttagcaaaaaatgagaatgagttgatcgatagttgtgattactcctgcgaaacatcatcccacgcgtccggagaaagctggcgaccgatatccggataacgcaatggatcaaacaccgggcgcacgccgagtttacgctggcgtagataatcactggcaatggtatgaaccacaggcgagagcagtaaaatggcggtcaaattggtaatagccatgcaggccattatgatatctgccagttgccacatcagcggaaggcttagcaaggtgccgccgatgaccgttgcgaaggtgcagatccgcaaacaccagatcgctttagggttgttcaggcgtaaaaagaagagattgttttcggcataaatgtagttggcaacgatggagctgaaggcaaacagaataaccacaagggtaacaaactcagcaccccaggaacccattagcacccgcatcgccttctggataagctgaataccttccagcggcatgtaggttgtgccgttacccgccagtaatatcagcatggcgcttgccgtacagatgaccagggtgtcgataaaaatgccaatcatctggacaatcccttgcgctgccggatgcggaggccaggacgccgctgccgctgccgcgtttggcgtcgaacccattcccgcctcattggaaaacatactgcgctgaaaaccgttagtaatcgcctggcttaaggtatatcccgccgcgccgcctgccgcttcctgccagccaaaagcactctcaaaaatagaccaaatgacgtggggaagttgcccgatattcattacgcaaattaccaggctggtcagtacccagattatcgccatcaacgggacaaagccctgcatgagccgggcgacgccatgaagaccgcgagtgattgccagcagagtaaagacagcgagaataatgcctgtcaccagcgggggaaaatcaaaagaaaaactcagggcgcgggcaacggcgttcgcttgaactccgctgaaaattatgccataggcgatgagcaaaaagacggcgaacagaacgcccatccagcgcatccccagcccgcgcgccatataccatgccggtccgccacgaaactgcccattgacgtcacgttctttataaagttgtgccagagaacattcggcaaacgaggtcgccatgccgataaacgcggcaacccacatccaaaagacggctccaggtccaccggcggtaatagccagcgcaacgccggccaggttgccgctacccacgcgcgccgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaatgaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaatcattcttagcgtgaccgggaagtcggtcacgctacctcttctgaagcctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgcctggctttggtgaacagatgcgccagatcagcctgcattttgtaccaactgcgatcctttcgcgtcaggtgggcgtgattcgcaaacaggcgctgatccttaacttacccggtcagccgaagtctattaaagagacgctggaaggtgtgaaggacgctgagggtaacgttgtggtacacggtatttttgccagcgtaccgtactgcattcagttgctggaagggccatacgttgaaacggcaccggaagtggttgcagcattcagaccgaagagtgcaagacgcgacgttagcgaataaaaaaatccccccgagcggggggatctcaaaacaattagtgggattcaccaatcggcagaacggtgcgaccaaactgctcgttcagtacttcacccatcgccagatagattgcgctggcaccgcagatcagcccaatccagccggcaaagtggatgattgcggcgttaccggcaatgttaccgatcgccagcagggcaaacagcacggtcaggctaaagaaaacgaattgcagaacgcgtgcgcctttcagcgtgccgaagaacataaacagcgtaaatacgccccacagacccaggtagacaccaaggaactgtgcatttggcgcatcggtcagacccagtttcggcatcagcagaatcgcaaccagcgtcagccagaaagaaccgtaagaggtgaatgcggttaaaccgaaagtgttgccttttttgtactccagcagaccagcaaaaatttgcgcgatgccgccgtagaaaatgcccatggcaagaataataccgtccagagcgaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaatcgtcacgcgataggcgctgccgctgaccgctttaaccccatttagtgccgcacctacagggcctcccagccccgcgccgcgcagcaaaccatgcccaagtacgctcattgctgcgtgggtgcgtaaaatgcgggtcagttggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcccgatacaatttaccgtgtccgcgcagtttgttggcgatactatcgccaccaaaatgctgtaattctccggcaatcagctgccagttgcggcgatgttgctcgggatgcccttccatcgatttaaacagttcgttgcgcatcagtacgctggagaggcgagttttgcctttttcattatgggtgagcaatcgggcgaaatttgccaactgttcctcactacaatgctgaagaaaatccagatctgaatcattcaggtaattaacattcattttttgtggcttctatattctggcgttagtcgtcgccgataattttcagcgtggccatatccgatgagttcaccgtatgacccgaaaaggtgatttttgagacgcagcgtttattgtcgttatcgctgttaatgttgatccagtcagtggtttgcccttcttttatttctgaaggaatattcaggctctgactggcgctacgggcggctttgaaataaaccgatgcaccgcttaactgtaaatcgccatggtcggcagagagttgtatgcgtttcacaatgcgacaaacaggaagtttcagcgccagatcgttggtttcgttacgcggcattgcaatggcgccgaggagtttatggtcgtttgcctgcgccgtgcagcacagcatcaggctaatcgccaggctggcggaaatcgtaaaaacggatttcataaggattctcttagtgggaagaggtagggggatgaatacccactagtttactgctgataaagagaagattcaggcacgtaatcttttctttttattacaattttttgatgaatgccttggctgcgattcattctttatatgaataaaattgctgtcaattttacgtcttgtcctgccatatcgcgaaatttctgcgcaaaagcacaaaaaatttttgcatctcccccttgatgacgtggtttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctagttggtcagccggctaaacgtcaggcagtgacgaacccgcaaaacactctgtttgcgattaaacgcctgattggtcgccgcttccaggacgaagaagtacagcgtgatgtttccatcatgccgttcaaaattattgctgctgataacggcgacgcatgggtcgaagttaaaggccagaaaatggcaccgccgcagatttctgctgaagtgctgaaaaaaatgaagaaaaccgctgaagattacctgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggcactggcaaccgtactatcgcggtttatgacctgggtggtggtactttcgatatttctattatcgaaatcgacgaagttgacggcgaaaaaaccttcgaagttctggcaaccaacggtgatacccacctggggggtgaagacttcgacagccgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccatacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtaaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctagatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaatttaaaaaagatggctaagcaagattattacgagattttaggcgtttccaaaacagcggaagagcgtgaaatcagaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggtggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacttgtccgacctgtcatggttctggtcaggtgcagatgcgccagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctgtattgcgaagtcccgatcaacttcgctatggcggcgctgggtggcgaaatcgaagtaccgacccttgatggtcgcgtcaaactgaaagtgcctggcgaaacccagaccggtaagctattccgtatgcgcggtaaaggcgtcaagtctgtccgcggtggcgcacagggtgatttgctgtgccgcgttgtcgtcgaaacaccggtaggcctgaacgaaaggcagaaacagctgctgcaagagctgcaagaaagcttcggtggcccaaccggcgagcacaacagcccgcgctcaaagagcttctttgatggtgtgaagaagttttttgacgacctgacccgctaacctccccaaaagcctgcccgtgggcaggcctgggtaaaaatagggtgcgttgaagatatgcgagcacctgtaaagtggcggggatcactcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttcagcatataggaggcctcgggttgatggtaaaatatcactcggggcttttctctatctgccgttcagctaatgcctgagacagacagcctcaagcacccgccgctattatatcgctctctttaacccattttgttttatcgattctaatcctgaagacgcctcgcatttttgtggcgtaattttttaatgatttaattatttaactttaatttatctcttcatcgcaattattgacgacaagctggattatttttgaaatattggcctaacaagcatcgccgactgacaacaaattaattattacttttcctaattaatccctcaggaatcctcaccttaagctatgattatctaggcttagggtcactcgtgagcgcttacagccgtcaaaaacgcatctcaccgctgatggcgcaaattcttcaatagctcgtaaaaaacgaattattcctacactataatctgattttaacgatgattcgtgcggggtaaaatagtaaaaacgatctattcacctgaaagagaaataaaaagtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttgacaggacggtttaccggggagccataaacggctcccttttcattgttatcagggagagaaatgagcatgtctcatatcaattacaaccacttgtattacttctggcatgtctataaagaaggttccgtggttggcgcagcggaggcgctttatttaactccacaaaccattaccggacagattcgagcgctggaagagcgcctgcaaggcaaattatttaaacgcaagggacgtggtctcgaacccagcgagctgggagaactggtctatcgctatgccgataaaatgttcaccttaagccaggaaatgctggatattgtgaactatcgcaaagaatccaatttattgtttgacgttggcgtggctgatgcactttccaaacgcctggtcagtagcgtacttaacgccgcagtggtagaaggcgagcccattcatcttcgctgcttcgaatccacccacgaaatgctgctggagcaattaagtcagcataaactggatatgatcatttctgactgtccgatagactctacgcagcaggaaggcctgttctccgtgagaattggcgaatgtggcgtgagtttctggtgtacaaatccaccaccagaaaaaccgttcccggcttgtctggaagaacggcgacttttgattcctgggcgacgttcaatgttagggcgcaaattgcttaactggtttaactcccagggattaaacgtagaaatcctcggcgagtttgatgatgccgctttgatgaaagcttttggtgcgatgcacaatgcaatcttcgttgccccaacgctttatgcatatgacttttatgccgataaaactgtcgtagaaattggtcgcgtcgagaatgtgatggaagagtaccatgctatttttgctgagcggatgattcagcacccggcggtacagcgaatctgcaatacggattattctgcgctttttagtccagcggtgcgttaatcggcagctcccccaaagttaaggtgggggagatagattagttgtacattaccacgattttgactcggctcattatttgcccgcttgagacattgtttccatatgtacgcgggcgaataaatagaggaatctgattacttccttcatggggatgctgaaaagagtagtaattgctggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacctacctcaatgtgtatcacaatatccatattctttgtgggggagtctggagattgagtagatattcttgttcagaatgtatcagccgatggttctacgattcttaagccacgaagagttcagatagtacaacggcatgtctcttttgactatctggcaaccggcagtgtgttctctcacgcatcacaaaagcagcaggcataaaaaaacccgcttgcgcgggctttttcacaaagcttcagcaaattggcgattaagccagtttgttgatctgtgcagtcaggttagccttatgacgtgcagctttgtttttgtggatcagacctttagcagcctgacggtccacgatcggttgcatttcgttaaatgctttctgtgcagcagctttgtcgccagcttcgatagctgcgtatactttcttgatgaaagtacgcatcatagagcgacggcttgcgttgtgcttacgagccttttcagactgaatggcgcgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgataaaaattgcagcaggcggtcagtttcttcccgtgatttgcgccatggcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctaccgataaagccccggcaagactgacccggctgcgggaaaaactgcgttaccttgcagagtgtggcgttgattacgtgctgtgcgtgcgtttcgacaggcgtttcgcggcgttaaccgcgcaaaatttcatcagcgatcttctggtgaagcatttgcgcgtaaaatttcttgccgtaggtgatgatttccgctttggcgctggtcgtgaaggcgatttcttgttattacagaaagctggcatggaatacggcttcgatatcaccagtacgcaaactttttgcgaaggtggcgtgcgcatcagcagcaccgccgtgcgtcaggcccttgcggatgacaatctggctctggcagagagtttactggggcacccgtttgccatctccgggcgtgtagtccacggtgatgaattagggcgcactataggtttcccgacggcgaatgtaccgctgcgccgtcaggtttccccggtgaaaggggtttatgcggtagaagtgctgggcctcggtgaaaagccgttacccggcgtggcaaacatcggaacacgcccaacggttgccggtattcgccagcagctggaagtgcatttgttagatgttgcaatggacctttacggtcgccatatacaagtagtgctgcgtaaaaaaatacgcaatgagcagcgatttgcgtcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaacccggaatgctggcgcgttggactgatgatgatctgtacggcatcatccgtgcggctaaaaaaggcaaaaaaaccttcattctgcatgatggccctccttatgcgaatggcagcattcatattggtcactcggttaacaagattctgaaagacattatcgtgaagtccaaagggctttccggttatgactcgccgtatgtgcctggctgggactgccacggtctgccgatcgagctgaaagtcgagcaagaatacggtaagccgggtgagaaattcaccgccgccgagttccgcgccaagtgccgcgaatacgcggcgacccaggttgacggtcaacgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccagttcactggtgcgttgactgccgttctgcgctggcggaagcggaagttgagtattacgacaaaacttctccgtccatcgacgttgctttccaggcagtcgatcaggatgcactgaaagcaaaatttgccgtaagcaacgttaacggcccaatctcgctggtaatctggaccaccacgccgtggactctgcctgccaaccgcgcaatctctattgcaccagatttcgactatgcgctggtgcagatcgacggtcaggccgtgattctggcgaaagatctggttgaaagcgtaatgcagcgtatcggcgtgaccgattacaccattctcggcacggtaaaaggtgcggagcttgagctgctgcgctttacccatccgtttatgggcttcgacgttccggcaatcctcggcgatcacgttaccctggatgccggtaccggtgccgttcacaccgcgcctggccacggcccggacgactatgtgatcggtcagaaatacggcctggaaaccgctaacccggttggcccggacggcacttatctgccgggcacttatccgacgctggatggcgtgaacgtcttcaaagcgaacgacatcgtcgttgcgctgctgcaggaaaaaggcgcgctgctgcacgttgagaaaatgcagcacagctatccgtgctgctggcgtcacaaaacgccgatcatcttccgcgcgacgccgcagtggttcgtcagcatggatcagaaaggtctgcgtgcgcagtcactgaaagagatcaaaggcgtgcagtggatcccggactggggccaggcgcgtatcgagtcgatggttgctaaccgtcctgactggtgtatctcccgtcagcgcacctggggtgtaccgatgtcactgttcgtgcacaaagacacggaagagctgcatccgcgtacccttgaactgatggaagaagtggcaaaacgcgttgaagtcgatggcatccaggcgtggtgggatctcgatgcgaaagagatcctcggcgacgaagctgatcagtacgtgaaagtgccggacacattggatgtatggtttgactccggatctacccactcttctgttgttgacgtgcgtccggaatttgccggtcacgcagcggacatgtatctggaaggttctgaccaacaccgcggctggttcatgtcttccctaatgatctccaccgcgatgaagggtaaagcgccgtatcgtcaggtactgacccacggctttaccgtggatggtcagggccgcaagatgtctaaatccatcggcaataccgtttcgccgcaggatgtgatgaacaaactgggcgcggatattctgcgtctgtgggtggcatcaaccgactacaccggtgaaatggccgtttctgacgagatcctgaaacgtgctgccgatagctatcgtcgtatccgtaacaccgcgcgcttcctgctggcaaacctgaacggttttgatccagcaaaagatatggtgaaaccggaagagatggtggtactggatcgctgggccgtaggttgtgcgaaagcggcacaggaagacatcctcaaggcgtacgaagcatacgatttccacgaagtggtacagcgtctgatgcgcttctgctccgttgagatgggttccttctacctcgacatcatcaaagaccgtcagtacaccgccaaagcggacagtgtggcgcgtcgtagctgccagactgcgctatatcacatcgcagaagcgctggtgcgctggatggcaccaatcctctccttcaccgctgatgaagtgtggggctacctgccgggcgaacgtgaaaaatacgtcttcaccggtgagtggtacgaaggcctgtttggcctggcagacagtgaagcgatgaacgatgcgttctgggacgagctgttgaaagtgcgtggcgaagtgaacaaagtcattgagcaagcgcgtgccgacaagaaagtgggtggctcgctggaagcggcagtaaccttgtatgcagaaccggaactgtcggcgaaactgaccgcgctgggcgatgaattacgatttgtcctgttgacctccggcgctaccgttgcagactataacgacgcacctgctgatgctcagcagagcgaagtactcaaagggctgaaagtcgcgttgagtaaagccgaaggtgagaagtgcccacgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcggcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcgctgggcaacctgttcgaccgcctgtggcacggcttcgttgtcgatatgatcgacttctacgtcggcgactggcacttcgccaccttcaaccttgccgatactgccatctgtgtcggtgcggcactgattgtgctggaaggttttttgccttctagagcgaaaaaacaataataaaccctgccggatgcgatgctgacgcatcttatccggcctacagattgctgcgaaatcgtaggccggataaggcgtttacgccgcatccggcaaaaatccttaaatataagagcaaacctgcatgtctgaatctgtacagagcaatagcgccgtcctggtgcacttcacgctaaaactcgacgatggcaccaccgccgagtctacccgcaacaacggtaaaccggcgctgttccgcctgggtgatgcttctctttctgaagggctggagcaacacctgttggggctgaaagtgggcgataaaaccaccttctcgttggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtacataaccgctatgtggtcgatagcttgcgtgagcgtggggctatctttattgagcagattagcgaagtaccggacggcgcgatcctgattttctccgcacacggtgtttctcaggcggtacgtaacgaagcaaaaagtcgcgatttgacggtgtttgatgccacctgtccgctggtgaccaaagtgcatatggaagtcgcccgcgccagtcgccgtggcgaagaatctattctcatcggtcacgccgggcacccggaagtggaagggacaatgggccagtacagtaacccggaagggggaatgtatctggtcgaatcgccggacgatgtgtggaaactgacggtcaaaaacgaagagaagctctcctttatgacccagaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagaacaggcggaagttgtgttggtggtcggttcgaaaaactcctccaactccaaccgtctggcggagctggcccagcgtatgggcaaacgcgcgtttttgattgacgatgcgaaagacatccaggaagagtgggtgaaagaggttaaatgcgtcggcgtgactgcgggcgcatcggctccggatattctggtgcagaatgtggtggcacgtttgcagcagctgggcggtggtgaagccattccgctggaaggccgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatactgaccccggcattgacgatgccgtcgccattgccgccgcgatttttgcacccgaactcgacctgcaactgatgaccaccgtcgcgggtaatgtctcggttgagaaaactacccgcaatgccctgcaactgctgcatttctggaatgcggagattccgctcgcccaaggggccgctgtgccactggtacgcgcaccgcgtgatgcggcatctgtgcacggcgaatcgggaatggctggctacgactttgttgagcacaaccgaaagccgctcgggataccggcgtttctggcgattcgggatgccctgatgcgtgcaccagagcctgttaccctggtggccatcggcccgttaaccaatattgcgctgttactttcacaatgcccggaatgcaagccgtatattcgccgtctggtgatcatgggtggttctgccggacgcggcaactgtacgccaaacgccgagtttaatattgctgccgatccagaagctgctgcctgtgtcttccgcagtggtattgaaatcgtcatgtgcggtttggatgtcaccaatcaggcaatattaactcctgactatctctctacactgccgcagttaaaccgtaccgggaaaatgcttcacgccctgtttagccactaccgtagcggcagtatgcaaagcggcttgcgaatgcacgatctctgcgccatcgcctggctggtgcgcccggacctgttcactctcaaaccctgttttgtggcagtggaaactcagggcgaatttacctcaggcacgacggtggttgatatcgacggttgcctgggcaagccagccaatgtacaggtggcattggatctggatgtgaaaggcttccagcagtgggtggctgaggtgctggctctggcgtcgtaacctgtcacatgttattggcatgcagtcattcatcgactcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaaccacaaaatatttgttatggtgcaaaaataacacatttaatttattgattataaagggctttaatttttggcccttttatttttggtgttatgtttttaaattgtctataagtgccaaaaattacatgttttgtcttctgtttttgttgttttaatgtaaattttgaccatttggtccacttttttctgctcgtttttatttcatgcaatcttcttgctgcgcaagcgttttccagaacaggttagatgatctttttgtcgcttaatgcctgtaaaacatgcatgagccacaaaataatataaaaaatcccgccattaagttgacttttagcgcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataatagcgtgtcatggcagatatttttcatccgctaatttgatcgaataactaatacggttctctgatgaggaccgtttttttttgcccattaagtaaatcttttggggaatcgatatttttgatgacataagcaggatttagctcacacttatcgacggtgaagttgcatactatcgatatatccacaattttaatatggccttgtttaattgcttcaaaacgagtcatagccagacttttaatttgtgaaactggagttcgtatgtgtgaaggatatgttgaaaaaccactctacttgttaatcgccgaatggatgatggctgaaaatcggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgtcagcgactggttaaagtggtcgatatcgatgagcaaatttacgcgcgcctgcgcaataacagtcgggaaaaattagtcggtgtaagaaagacgccgcgtattcctgccgttccgctcacggaacttaaccgcgagcagaagtggcagatgatgttgtcaaagagtatgcgtcgttaattttatctcgttgataccgggcgtcctgcttgccagatgcgatgttgtagcatcttatccagcaaccaggtcgcatccggcaagatcaccgtttaggcgtcacatccgtcgtcccctgcaaacgggggcgattttcctccatttgcctcagtggctgcgtttcatgtaacgatacatgacagcgcccgacaagatcctgatactctttggtattcaaccgtttccagtgtaactcgtcgtcactaacattgcgtacagcgcgggctggcgtacccatcaacaactggcgtttctcgccgcgaaagcccgctttgacaaagctcatggcggcaacaatgctctcttcgccaatgaccgcgccatccataatcacgctgttcatcccgaccaatgcatcgcgaccaatcaaacaaccatgcaggatcgctccgtgcccgatatggccgttttccccaacgatagtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaagacggcactgggatggacaaacgccgtcgggtgaaccaccggaattaacccctcaaaggcgtaatagctcacggttgttaacgtcctttccacaccggatcgcgcttctcggcaaacgccagcggcccttcaatggcatcttccgaatgcagaaccgatggatagtgtttcaacacgccgctgcgaatatagcgatacgcttcttctaccggcatttcgctggtggtgcggtagatctctttcagcgccgcaatcgccagcggggcgctgttaaccagctgctgagccagttcgcgggcgttatccatcagttccgcctggctaaccacgcggttgactatcccccaacgcagcgcctcttctgcgcccattcgtctgccggtcatcaccatttcattgacgatggcaggcggcaggatcttcggcagacgcagcacaccgccgctgtcaggaacgatgcccagtttggcttccggcagggcgaagctggcgttatcggcacaaacaataaaatctgccgccagcgccagttcaaagccgccgccaaaggcatagccgttcacagctgcgataaccggtttgtcgagattgaaaatttcggttaatcccgcaaaaccacccggaccaaagtcagcatccggtgcttcgccttctgctgccgcttttaaatcccagcccgcggaaaagaacttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagtgtgattattagctggcagggtagttccctgctgtttcatttatttcagattctttctaattattttccccgagcaattacgtggcagatcttttctgatctccagataagagggcactttaaatttcgccatattttgttcgcagaagcggaaaaattcctcttcgctcaatgtttcaccttcattcagcaccacaaatgctttgatggcttcatcgcgaatcgaatctttaatacccacaaccacgatgtcctgaattttcgggtgcgcggcgataatattttccagctccacgcaggagacattctcgccgccacgtttaatcatattgcagcggcgatcgacgaaataaaaaaagtcctcttcgtcgcggtatccggtatcgccggtatgcagccagccatcggcttccagcactttcgcagtggcttgtgggttgagaaagtactctttgaagatggttttcccaggtatgcctttaatgcagatttcaccgatctcaccagccgggagcgggcgattgtgatcgtcgcggatctccgcttcgtagcaaaaccccacccgaccaatcgacggccagcgtcgtttatcgccaggacgatcgccgataatgcccacaatggtttccgtcatcccataagacgtcagcaagcgaacgccgaagcgttcacaaaacgcatctttttcctgctccgacaagttgagataaaacatcacttcccgcaggcggtgttgctgatcgttcgctgaaggcggctgtaccatcaacgtacggatcatcatcggaatacattcggtaacggtggcgcggtacttctgtacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacacctttcggtcgggaggtggtgccggaggtgaagagaatttccgccgtatcgtcagtcgatagcggcggtgcatagcacaaggtggcaggttgttgatttttcagttgagtaaacgaactcacgccatcatcagcgggaagtgccacatctgtcaggcaaatgtgccgcaattgagtggcatcttcctgctgaatctgttgatacataggatagaattgcgcactggtcaccagcaggcacgcctggctattttgcaggatccacgcgctttcctcgcacaacaggcgggcgttaatcggcaccataatcgcgccaatttttgccagcccgaaccagcaaaagataaattccgggcagttgtcgagatgtagtgcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgcaagatcgtcccacatttgacgtagatgttgtccgccaatgatatccattgcacctctatccatttttgttcgtttgttattgggcgggcgctagtcaggcaagccgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatgttcggccctttgcaggtgcgaccatccatcgtttgccactgagtgattgattcgcgagccacatactgtggattgctttccagttccggtacggtcagcactttggcgcaggcgatattcagttcagcaaagcgttcttttacttccgcgatggtatgtgtcgccagccaggcatcgagtttctcttcaaccagtgggccgtaagggcattcgatacggtggataagctgagtgccttccgggatttctggcgtgccaagcagatgtgcgaggccaatatctttaaagcactcttcaatttgggtaatgcccaccagttccatcacgatgtagccgtcggcacatttatacagaccgcaaccggcgtagtagggatctttacctttgctcatgcgcgggcacatttcgccgccgttgaagtaatccatcatgaagtactggcccatacgcagcatcacttcatacatggcgatgtcgatactttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactaaaggcctgggcgatagtgttataggccggaagattggtgtactcctcggtgccgtactgaccaaaaccggacaggtgagcgataaccagtttcgggttgtgctgccacagtacttcatcggtaatgccacgacgggcaaaggccggacctttactggcttcgatgaagatatcggtggtttccattaatttcagaaacgcttcgcggccttcatctttgaaaatatttaacgacagcgcgtgcaaattgcggcgggagagttgcgggtagttcggttgaacgcgaatggtgtcggcccaggcgacgttctcgatccagataacttccgcgccccattctgcgaacatttgcccggcaaacggtccggcgatttcgataccggagaagacaacgcgcaatccggccaacggcccgaatttcggcatgggtagatgatccattatttgctcctgaaaaatttatgtagcgcatgactgccggatgcggcgtaaacgctttatccggcctacattcgtgctcccgtaggcctgataagacgcatcagcgtcgcatcaggcagcgcacggacttagcggtattgcttcagcaccgcacgacccagcgtcaggatctgcatttcgtcagatcccccggagacgcggtctacacgcagatcacgccagaagcggctgatgcggtggttgcccgcaatcccgacaccgcccagcacctgcattgcgctatccacaacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacgcgctgattggcgtagcgcgccgcatcttcaaaggcgcacatcgccgtaccgtagttggtgagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcccgcgcccggttcggtaatcgctgagttccacatctgcttaccggtgccgcggaaagccataattttgtcgatctgctcttgtgtgccttcgcgcaggaaggtgttgaacccgcccggcaactggtacagcacataggttggtgcccccagacgtcccagctccatccacacggcggcgagagtaacaaaccccgcgtccagaccaccgtgctcttcagggatcagcagactgtcgatacccatatccgccagtgctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccataatgttgacgaagaacagcgggcatcctccggcgataatggcggtttgaatcggtttcaggccgccgagcgccagcagaacaataccgataatgccaaccagaattgaccaaccgatacgcaccagcagaggtggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcaatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacagtacgaccacgggagatgcgggcgaggaagatactcatctggatagcataaatcacccaccatgcccagtagaacacggtccagccctgcgggaagccgcctttagcgatgggatcggtatagaacaacatgcgcggcagatacatcagcaacatccccaccgaatcggtgaagtagttcatgatgaagctggcaccgctgacaatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagtgtcgagctggggcgaatcacttccattttgcggacaaagaagaagtaagcgaaggcgactgaaaggaagctgtaagtggcccacggcagaggtccccagtggaacaagctgtaagccagccccaactctttcgcccctgtcgagttcggttctaagccaaacggcggggtggagatgtagtagtagatctcaatcgatccccagaacagtacggcagcagacgtacaggaggcgaacatcataaagatccaactggcggtgctaaattctggcggttcgttacctaaacgctttttggcatacgggccaaacaccagccagaaccaaccgaaaagcatcaccaccatataccattcaaatgcccatccccatacattggtgacgtaactgaatacagcattaataacgacattcgctgcatccagatctctgactgtaagccaacaaagtatgccgacgattattaacggcggaaagaaaaccttcggttctattcccgtttttctcttttcattcttcatgagttaattccactgtgaaaacgaatatttattttgcgttcccgtttgttttatttttgttaacatttaatataattattattaacctcgtggacgcgttaatggctaactcataatgggtattcaataagctgtattctgtgattggtatcacatttttgtttcgggtgaatagagggcgttttttcgttaattttgattaataatcagtttgttatgctctgttgtgagtaaaaaataacatctgactttcaatattggtgatccataaaacaatattgaaaatttctttttgctacgccgtgttttcaatattggtgaggaacttaacaatattgaaagttggatttatctgcgtgtgacattttcaatattggtgattaaagttttatttcaaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcattagacttcagcaaagccgatgccaaaataagccaatacgatctcaacgctattgaagcggcttgccagctaaagcaacaggcagcagaggcgcaggtgacagccttaagtgtgggcggtaaagccctgaccaacgccaaagggcgtaaagatgtgctatcgcgcggcccggatgaactgattgtggtgattgatgaccagttcgagcaggcactgccgcaacaaacggcgagcgcactggctgcagccgcccagaaagcaggctttgatctgatcctctgtggcgatggttcttccgacctttatgcccagcaggttggtctgctggtgggcgaaatcctcaatattccggcagttaacggcgtcagcaaaattatctccctgacggcagataccctcaccgttgagcgcgaactggaagatgaaaccgaaaccttaagcattccgctgcctgcggttgttgctgtttccactgatatcaactccccacaaattccttcgatgaaagccattctcggcgcggcgaaaaagcccgtccaggtatggtcggcggcggatattggttttaacgcagaggcagcctggtcagaacaacaggttgccgcgccgaaacagcgcgaacgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacctttgtcctcaatgatgccgacggcgcacaggcaatccagctcggcgctaatcatgtctggaaattaaacggcaaaccggacgatcggatgatcgaagattacgccggtgtcatggctgacactattcgccagcacggcgcagacggcctggtgctgctgccaaacacccgtcgcggcaaattactggcggcaaaactgggttatcgccttaaagcggcggtgtctaacgatgccagcaccgtcagcgtacaggacggtaaagcgacagtgaaacacatggtttacggtggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgccagagcaacagcgtcgatctcgacaaagcccgtctggtggtcagcgtcggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaacgcgtcgcaaaccattttcgccatcaataaagataaaaatgcgccgatcttccagtacgcggattacggcattgttggcgacgccgtgaagatccttccggcgctgaccgcagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgtggcaattccgcaggtgccaagaacgtcaccggcgggcgtctctatgcccacagtctggaacacattattcctggtttcgccgactccgcccccgtagaacgcctgatcacccatgaaaaactcgcgtttatgacggaaaagtcagcgatgactatggactactgcaatggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaactccatccttgccgaaaaattggggatggcaaaacgcgtcaaaccgacggatgtggcggttggcgtgaaggaactgatcgagttaccgaagtcggttattgaagaccgttttcagttgcagggtaatcagggggcggcttgcctgtttgcgggatcacccaccgatggcctgatgggcggcggcttcctttataccaatgaaaacaccctgtcgctggggctggtttgtggtttgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagttggttggtgacggcgtattgattgccggtgatgccgccggaatgtgtatgaacctcggttttaccattcgcggtatggatctggcgattgccgccggggaagccgcagcaaaaaccgtgctttcagcgatgaaaagcgacgatttcagtaagcaaaaactggcggaatatcgtcagcatcttgagagtggtccgctgcgcgatatgcgtatgtaccagaaactaccggcgttccttgataacccacgcatgtttagcggctacccggagctggcggtgggtgtggcgcgtgacctgttcaccattgatggcagcgcgccggaactgatgcgcaagaaaatcctccgccacggcaagaaagtgggcttcatcaatctaatcaaggatggcatgaaaggagtgaccgttttatgacttctcccgtcaatgtggacgtcaaactgggcgtcaataaattcaatgtcgatgaagagcatccgcacattgttgtgaaggccgatgctgataaacaggcgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaacgccgcactgactctcattgcaaaaaacaggaataaccatgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaaattgttcagatttctctcttttctgaatcaatattattgactataagccgcgtgaatatatgactacactttgtgggaaaacaaaggcgtaatcacgcgggctacctatgattcttataatttatgcgcatccgtatccgcatcattcccatgcgaataaacggatgcttgaacaggcaaggacgctggaaggcgtcgaaattcgctctctttatcaactctatcctgacttcaatatcgatattgccgccgagcaggaggcgctgtctcgcgccgatctgatcgtctggcagcatccgatgcagtggtacagcattcctccgctcctcaaactttggatcgataaagttttctcccacggctgggcttacggtcatggcggcacggcgctgcatggcaaacatttgctgtgggcggtgacgaccggcggcggggaaagccattttgaaattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcgtcactataagcaacgtctgctggaatggcaggaggcccatcatggatagccatacgctgattcaggcgctgatttatctcggttcggcagcgctgattgtacccattgcggtacgtcttggtctgggatcggtacttggctacctgatcgccggctgcattattggcccgtgggggctgcgactggtgaccgatgccgaatctattctgcactttgccgagattggggtggtgctgatgctgtttattatcggcctcgaactcgatccacaaaggctgtggaagctgcgtgcggcagtgttcggctgtggcgcattgcagatggtgatttgcggcggcctgctggggctgttctgcatgttacttgggctgcgctggcaggtcgcggaattgatcggcatgacgctggcgctctcctctacggcgattgccatgcaggcgatgaatgaacgcaatctgatggtgacgcaaatgggtcgcagtgcctttgcggtgctgctgttccaggatatcgcggcgatcccgctggtggcgatgattccgctactggcaacgagcagtgcctcgacgacgatgggcgcatttgctctctcggcgttaaaagtggcgggtgcgctggtgctggtggtattgctggggcgctatgtcacgcgtccggcgctgcgttttgtagcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggagagcgatatcgaaccatttaaaggtttgctgttggggctgtttttcatcggtgttggcatgtcgatagactttggcacgctgcttgaaaacccattgcgcattgtcattttgctgctcggtttcctcatcatcaaaatcgccatgctgtggctgattgcccgaccgttgcaagtgccaaataaacagcgtcgttggtttgcggtgttgttagggcagggcagtgagtttgcctttgtggtatttggcgcggcgcagatggcgaatgtgctggagccggagtgggcgaaatcgctgaccctggcggtggcgctgtcgatggcagcaacgccgattctgctggtgatcctcaatcgccttgagcaatcttctactgaggaagcgcgtgaagccgatgagatcgacgaagaacagccgcgcgtgattatcgccggattcggtcgttttgggcagattaccggacgtttactgctctccagcggggtgaaaatggtggtactcgatcacgatccggaccatatcgaaaccttgcgtaaatttggtatgaaagtgttttatggcgatgccacgcggatggatttactggaatctgccggagcggcgaaagcggaagtgctgattaacgccatcgacgatccgcaaaccaacctgcaactgacagagatggtgaaagaacatttcccgcatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgtgccgatgtgttccgccgctttaatattcagatggtggaagagatggcaatggttgagaacgacaccaaagcccgcgcggcggtctataaacgcaccagcgcgatgttaagtgagatcattaccgaggaccgcgaacatctgtcattaattcaacgacatggctggcagggaaccgaagaaggtaaacataccggcaacatggcggatgaaccggaaacgaaaccctcatcctaataaagagtgacgtaaatcacactttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaattttgtatagaatttacggctagcgccggatgcgacgccggtcgcgtcttatccggccttcctatatcaggctgtgtttaagacgccgccgcttcgcccaaatccttatgccggttcgacggctggacaaaatactgtttatcttcccagcgcaggcaggttaatgtaccaccccagcagcagccggtatccagcgcgtatataccttccggcgtacctttgccctccagcgatgcccagtgaccaaaggcgatgctgtattcttcagcgacagggccaggaatcgcaaaccacggtttcagtggggcaggggcctcttccggcgattctttgctgtacatatccagttgaccgttcgggaagcaaaaacgcatacgggtaaaagcgttggtgataaaacgcagtcttcccagcccccgcaattccggtgaccagttatttggcatatcgccgtacatggcatcaagaaagaagggataggagtcactcgatagcaccgcttctacatcgcgtgcgcactctttggcggtctgcagatcccactgcggcgtgatccctgcgtgggccatcaccagctttttctcttcgtcgatttgcagcagaggctggcgccgcagccagttaagcagctcgtcggcatccggcgcttccagcagcggtgtcaggcgatctttcggtttattgcggctgatcccggcaaataccgccagcagatgcagatcgtgattgcccagcaccagacgtacgctgtcgcctaaggatttcacatagcgcagaacatccagcgaacccggcccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgagcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcggtggtgatgcggctcaacacacgaacatctttaaccgggtgaggcatcgttgcatgaggaaccaggcgcacgacggcggaatccactttgggtggtggtgtaaaggctgacggcggtacttccagtaccgggatcacattgcaatagtattgcgccatgacgcttaatcgaccatacgctttgctgttcggtcctgcaaccagacgattcaccacctctttttgcaacataaagtgcatgtcggcaatggcatcagtatagctaaacagatggaacatcaacggcgtggagatgttataaggcaggttgccgaaaacacgcagcggctgacccattttctcggccagttcaccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttttgcgggttaatggcagacacaatactgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttgccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcaagatatttcggctgaaacagggtatcggcaggcagcggcccgttgagtttcatcccctgcgcccgcagctcattgagcaccggaataatggtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagtgcaggggtgatagcgtctgcgatatcgcgcagcggtaaatgcgtcgttgccagcgccacgcgaagttcttcggtcgccagcatcatcaccacctttttcgcctgcgaacgctcttcgaaaaactcggtatgaccggtaaaaggaatgccagcgtcgttaataacgcctttatgcaccggacctgtgatcagcgcggcaaattcgccgttcagacaaccatcgcacgctcgcgccagcgtttccaccacataatgcccattttcaaccgctaactgccccgcagtgacaggtgcacgtagcgcgacaggaagtagcgttaatgtgcccgcagtttgcggttgtgcaggggagttgggggaataagggcggagggtgagcggcaaaccgagcatcgctgcccggttggtaaggagagtggcatcggcacaaacaaccagttcgaccggccactcacgctgtgcaagctggacaactaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgcgcagcgtcggttttatcgacattacgggtatccagcagttcgattaaatgccagccgaatgaagagtgaaccggtgcactcatttgacctttgttcaggcgagtcagggcgtcacggaaggccggatcgaaaatatctggtgtagcccagccgagatcgccgccctggttagcagagcctggatcctgagagaactctttcgctgcggcagcaaaagtcgttttaccactcttgatatcagcagcaatctgttccagtttcacacgggcctgttcgtcagtcatgatcggcgacggtttcagcagaatatggcgagcatgaacttcggtcaccgagatatttttgctttcgccgcgcaggtcgttaactttcagaatatggaagccaacgccggaacgaatcgggccaacaatgtcgcctttcttcgcggtgcttaatgcctgggcgaagatcccgggcaactcctgaatacggccccagcccatctggccgccgttcagcgcctgctggtcggcagaatgagcaatcgccagcttaccgaaatcagcgccgttacgcgcctgatcgacaatggcgcgcgcctggctttccgcttcgttcacctgatcagaggtcgggttttccggcagcgggatcaggatgtggctcaggttcagctcagtgctggcgtcgttttggttacccacctgctgcgccagggattcgacttcctgcggcaggatggtgatgcgacgacgcacctcgttgttacgcacttcagagataatcatctctttgcggatctggttacgataggtgttgtagttcagtccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaattgcatagcagcaggagctgtattgcacacctaacatagagtcggcttgcttgttagcattggtgtcgtagtagtaggccccaacaatggaccaacgatcggcaattggccagctggcgacagcacctacctgcgaaataccattcttatattgctcagcagtggaatagtacttaggcagcgtagcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgctcggagatacgccagtaagtatcgcctgcccacaccagtgaacccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccagagtagtcagattgcagcagagacgagtcgtagttatagatgtcgctctgatcgcgatacggcacgtacaaatactgcgcgcgcggttccagcgtttgggtataacccggagccagcatttccatatcgcgttcaaagaccattttgccgtcaactttgaattgcggcattacgcggttaacggattcgtccagcttggtcgtgtttctggagttataccagtcaagattggtttgctgataatgggttgccagcaacttcgcttcggtattgatgctgccccagttattagagagcggcaaattgatggtcggttccaggtgaacacgggttgcttcaggcatgtcgtctctggtgttaacaaagtgcactgcctggccgtaaatacgcgtatcaaacggaccaacatcattctggtagtaattaacgtctaactgcggctctgccgagtagctactggtgttctgttcgctgaaaacctggaactgcttggttgaaacggtggcattgaagttttgcaccgcatagccaacgctgaatttttgcgttgcgtagccgtcagtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatcttcatagactttatctgaaggcagatagtccagttccatcaagccagcgcccgcctgggagaggtagcggaattcgttctcccacatgatgttgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcgaccctggcgacccaccatctggtaatcaccttcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtcagtggtgttaggcacggcattgaatgacaggtatgataatgcaaattataggcgatgtcccacaattgaccgcagccggaaaacggtaaaagcacctttatattgtgggagatagccctgatatccgtgtgtcgatttggggaatatatgcagtattggggaaaaatcattggcgtggccgtggccttactgatgggcggcggcttttggggcgtagtgttaggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagccagttgatggaccgaatgaatcttcatggcgcttcccgtactgcggcgcaaaatgcgttccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgcagaagaattagggatctcccgcgctcagtttgaccagtttttgcgcatgatgcagggcggtgcacagtttggcggcggttatcagcagcaaactggcggtggtaactggcagcaagcgcagcgtggcccaacgctggaagatgcctgtaatgtgctgggcgtgaagccgacggatgatgcgaccaccatcaaacgtgcctaccgtaagctgatgagtgaacaccatcccgataagctggtggcgaaaggtttgccgcctgagatgatggagatggcgaagcagaaagcgcaggaaattcagcaggcatatgagctgataaagcagcagaaagggtttaaatgaccctgtaaatgatgctgagtaactgcccacgattaaaggtggccgccctggcggtcacttctttgagaaaaggcgtttactcagaatggtggacaggctcaatgcacggtttacgggaggggttctgtaggttttatcgcgttgaccctgcttaaggttgagagctttacgacgagcggaattatatttttacgtcttaaaaataaaaaacacatacctgaatgagcgatttttgaaagtatatttattcagaacgcgcatcatgagtttttaactcaatgcgaggctattaccatgaaagtatcagttccaggcatgccggttacacttttaaatatgagcaagaacgatatttataagatggtgagcggggacaagatggacgtgaagatgaatatctttcaacgcttgtgggagacgttacgccatctgttctggtcagataaacagactgaggcttataaacttctgttcaatttcgtgaataaccagactggcaacatcaacgcctcagaatactttactggggctatcaacgagaatgagagagaaaagtttatcaatagcctggaattattcaataaacttaaaacatgcgcaaaaaatccggatgagttggtcgcaaagggcaatatgcgctgggtcgcccagaccttcggggatatcgagttaagtgtcacttttttcattgaaaagaataagatatgtactcagacgttgcagctgcataagggccaaggtaacttgggcgttgatcttagaaaggcttaccttcccggcgttgacatgagggattgttaccttggtaaaaaaacaatgaaaggtagcaatgatatcctttatgagagacctgggtggaatgctaacctgggcgtgctaccccggacggtgctaccccggacggtgctaacccggacggtgctaacctggacggtgctaccgtgaacggtgctacctccttatatgatgaggtaattattattaataaaatcccccccaaaaaaattgatactaaaggagttgctactgaagaagttgctactaaaaaagtactgctgaacaaattactgacaacgcaattattgaatgagccagaataagctaaggttgaaggggctggaacgccccttcaaccttagcagtagcgtgggatgatttcacaattagaaagacctgcatgatgagctagagaagaggctagtgacgcaaggcgtcgtgcaggacacggatcaccgagatgggcatcgccaaccagactgctaattagcccatgaataacaatcagaaaggaccataacagacccgttaaaatgaaatataagagacggtcaacgggtgaagaaaaagttcaaaaattcgctgtggagcaggaagggaattaccgaatggaaagcgtagccacacgcaacaactgaaagcagtttggcagaaacaaaaaatccccggactcggggatttatgtacaagaggcagcccttaggatgagggtataaacgtacaggaaaggttaaaaatccgctggcgctttaaacgtcatactattgccatacgccggatgggtaatcgtcaacatctctgcatgtagcaacaaacgtggtgccatcgctctcgcttctggtgatgcataaaaacgatcgccgagaatcggatgacccagcgccagcatatgcacacgcaattgatgcgaacgcccggtaatcggttttaacaccactcttgccgtgttatccgccgcatactccaccacttcatattccgtctgcgcaggtttacccgtttcgtaacagactttctgtttcgggcggtttggccagtcgcaaatcagcggcagatccaccagaccttctgcgggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcactgacaacaaaccgctcggcttgttgaccaccataatatggtcatcctgatacaggataaccaaccagggttcctgcggtggattgtagttttccatccccattttcggctccgttactgatgcgttacaacgatcaaacgcagggcatccagacgccaacctgcctgatccaggctttccattacctgctgacggttgctctcaatggcggtcagttcgtcgtcacgaatgttcgggttcactgcacgcagagcttccagacgagacagctcggcagacagtttttcgtcggcttcgttacgcgctgcatcaatcaatgcacgggcagatttctcgatctgcgcttcacccagttgaaggatagcgtgaacatcctgctgcacggcgttaaccagtttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgttttttaacagtgaaatcgtgctgctaccggtatcgccagaaaggatcagatccagaccgttgcggatcagcggatgctcccaggtaataaactgtgcatcttcacgcgccagcgccacttcacgatcaaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggagtggatttccagcaggcggtcacgaccctgttccagctgtgctttcagcgcttcatgttgctcgcggcagtttttgatcagatcgtcaaagccttcggtttgatccggtgaagccagatagttaatcagatcgttgtatacgctatcgtaaatagtgcgtccggtcgggcaggtgtgctcaaatgcatccagaccttcgtgataccagcgcaccagcaccgactgagcggttttctccagataaggcacatggatctgaatatcgtgcgcctggccgatacgatccagacgaccaatacgctgctccagtagatccgggttgaatggcaggtcaaacatcaccatgtggctggcgaactggaagttacgtccttcagaaccgatttctgagcacagcagtacctgtgcgccggtgtcttcttcggcaaaccaggcggcagcgcggtcacgttcgataatcgacataccttcgtggaacaccgcagcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcacgatcttccgcacttttacgtgcgcccataatgccggagactttaatagccgtctgatactgcgtcggtagcggcagcttaatggtgtgcagctcgcgtttcgggaatcctttcacaccgttacgcgtgttacggaacagcacgcggctggtgccgtggcgatccatcagcatcgaaaccagctcctgacgggcgctctgggcatcttcgctgtcgctgtttgctgcctgcaacagcggctcgatatcctgctcgccgatcatctcgccgagcatgttcagttcgtcattgctcagtttgttacctgccagcagcatggcaacggcgtccgcaaccggacgataatttttctgctcttcaacgaactgcgcaaaatcgtggaaacggttcgggtccagcagacgcagacgggcgaagtggctttccatccccagctgttccggggtcgcggtcagcagcagaacgcccggcacgtgctctgccagttgttcaatggcctgatattcacggcttggcgcatcttcgctccacaccaggtgatgcgcttcatcgaccaccagcaggtcccattcggcttcacagagatgttccaggcgctgtttgctacgacgggcaaaatccagcgagcaaatcaccagctgttcggtgtcaaacgggttgtaagcatcgtgctgagcttcggcataacgctcatcatcaaatagcgcaaagcgcaggttgaaacggcgcagcatttctaccagccactgatgctgtaaggtttccgggacgataattagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctgatgcgggatcaggctggtacgctgaccgcgcaggccgctgtacggcatacggaactgttcgctggaatatttacgcgcgcgataacgcagcgcaaagcggtccatacggtcaatctgcccggcaaacagacggtcctgcggtttgctgaacaccagtttgctatcaaggaaaacttcacgcagggctacgccggactcttcagtatccaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactcttttttttgctcaaaatagcccaagttgcccggtcataagtgtagcaaaattatcctcaataaaagggagtattccctccgccacgggttgtagctggcgggtcagatagtgttcgtaatccagtggtgaacgttggtagtccagcggctccgggccgttggtggtccatacgtacttaatggtgccgcgattctgatattgcaaggggcgaccacgcttttggttttcttcatcggcaaggcgagcggcgcgtacatgaggcggcacattacgctgatactcgctcagcggacggcgaaggcgtttacggtaaaccagtcgcgcatccagttcacccgccatcagtttgtcgatggtttcgcgtacatattcctgatatggctcgttgcggaagatgcgcaggtatagctcctgctgaaactgctgggccagcggcgtccagtcggtgcgcacggtttccagccctttaaacaccatccgctgcttgtcgccctcctgaatcagtccggcataacgctttttactgccggtatcggctccgcgaatggttggcatcagaaaacggcagaaatgggtttcatactccagttctaatgcgctggtcagccgttgtttttgcagcgtttccgcccaccaggcgttaacgtgctgcaccagtgcacgaccgattttcgccgcttcttcttccgaatgtgcgcctttcagccagacaaacgttgagtcggtatcgccgtagataacgtcgtagccctgtgcttcaatcaacgctttggtttgccgcatgatctgatgaccacgcatggtgatcgacgatgccagccgcggatcgaagaagcggcaggcggtggtgccgagcacgccataaaaggcattcatgatgattttcagcgcctgcgacagcggtttgttaccctggcgtttggcttcatcgcgcccgtgccagatgttagtcacaatctccggcaggcaatgtttttctcgcgagaaccaggcatcgagaaaaccttcggtactgtgctctggatcaggctgcgccatgccttccaccagcccgacgggatcaatcagaaaggtgcggatgatcgacgggtacaggcttttatagtccagcaccagcactgaatcataaagccctggccgtgaatccatcacgtagccgccagggctggcgtgcggcggcacttcgccgagattaggcgcgacataaccagcgcgatgcattcgcggaaaatagagatgaccaaatgccgccaccgaaccgccgtgtcggtccaccggcaggccgttcaccgttgcccgttcgagtaaaaatggcatgatttcagttttgtggaagatctgcgtcaccagctcgcaatctttcaggttataagttgccagcgcaggtttatcttcggcgaaacggcggtcaatttcgtccattcgatcccacgggttatcgatagattttccttcgcctaatagctcctgagcgacagtttccagcgagaatgaagagaaattccagaacgcggatttcagcgcctcgataccgtcgataattagccgacctttagcctgggcaaaaaagacgccgtttttaaagccgtgctcgcgccactccagctcgctattatcgcgcccaagacgcagcggaagacggtaacgctcggcatgtttttgcagcattcgcagatcgaactgcaccacgttccaaccgatgatcacatcaggatcgtagttggcaaaccaggcgttgagtttttccagcaactgcgggcggctggcgacgtattccagttcgaaatcaagcgaggaggcgtcgccattctccggccccagcatataaacgatgcgctgcccgcagccttccaggccgatgcagtacagctcaccgtggcgggtggtttcaatatctatagaaacccacttgagcggcggacgatagtcgggatgcggtttcagacgggcattaacgatagtgccattgtgcatatcaccctcgacccacaccggtgaggtgataaaccgctccatcagatagcgttctggcggacgcacatcggcctcgtagacggtaacgccaccttcacgcaggcgcttttcgtaattcatcaattggcgatgggcgcgacagtaaaggccatacaccggctggcggtgaaaatcctttaacgccagcggtgtcaggcgaaagccttgttcaccctgcaaaatatgctgagcgcggggaacctgatcggcgggaataaacgccacggactcttgcggtgcaagcgtaacctgcaacggcccgttgtccgtcgccagccagaaggagacttctgtcccttgcggggtgtcccgccagtgtcgggttaagataaaacctgcctgcgccacgctgaaaatccatcaaaaaaccaggcttgagtatagcctggtttcgtttgattggctgtggttttatacagtcattactgcccgtaatatgccttcgcgccatgcttacgcagatagtgtttatccagcagcgtttgctgcatatccggtaactgcggcgctaactgacggcagaatatccccatataagcgacctcttccagcacgatggcgttatgcaccgcatcttcggcatttttgccccatgcaaacgggccgtgggaatggaccagaacgccgggcatttgcgctgcatcgataccctgtttttcaaaggtttctacgatgacgttaccggtttcccactcatattcgccgttgatttctgcgtcggtcattttgcgggtgcagggaatggtgccgtagaaatagtcggcgtgggtggtgccggttgctggaatcgactgacccgcctgcgcccagatggtggcgtggcgcgagtgcgtatgcacaatgccgccaatggaggggaatgcctgatagagcagccggtgagttggcgtgtcggaggagggctttttcgtaccttcaaccacttcaccggtttcgatgctaaccacgaccatatcgtcagcggtcatgacgctgtaatcgacgccggaaggtttgatcacaaagacgccgcgctcgcgatcaacggcgctgacgttgccccatgtgagcgtgaccaggttgtgttttggcagcgccaggttggcttctaatacctggcgtttgagatcttctaacatgttgactccttcgtgccggatgcgctttgcttatccggcctacaaaatcgcagcgtgtaggcctgataagacgcgccagcgtcgcatcaggcgttgaatgccggatgcgctttgcttatccggcctacaaaatcgcagcgcgtaggcctgataagacgcgccagcgtcgcatcaggcgttgaatgccggatgcgctttgcttatccggcctacaaaatcgcagcgtgtaggccagataagacgcgtcagcgtcgcatcaggcgttacataccggatgcggctacttagcgacgaaacccgtaatacacttcgttccagcgcagcgcgtctttaaacgctggcaggcgtgtgtcgttatcaatcaccgtgatttcaatgtcgtgcatctcggcgaattggcgcatatcgttgaggttcagtgcatggctgaagacggtatggtgcgcgccaccagcgaggatccacgcttcggaagcagttggcagatccggttgcgctttccacagcgcattcgccaccggcagtttcggcagggagtgcggtgttttcaccgtgtcgatgcagttaaccagtagacggtaacgatcgccgagatcaatcaagctggcgacaatcgctgggccggtttgggtattgaagatcaggcgggcaggatcgtccttaccaccaataccgagatgctgaacgtcgaggatcggtttctcttctgcggcgatcgacgggcagacttccagcatatgggagccgagcaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtaaccctgctgcatcagacgctgtacggccagaccaggaagctgtttcagaccgtgcaaatcttcaaaggtggtggtgaacgcgtggaagccaccttgttccaggaaacgcttcatccccagctcaatacgcgccgcttccagcacgttctgtcgttttttgccgtggatttgtgtggcaggcgtcatggtgtagcagctttcgtactcatcgaccagcgcgttaacatcgccgtcgctgatggagttcaccacctgcaccagatcgccaaccgcccaggtattgacggagaaaccgaacttgatctgtgcggcaactttatcgccatcggtgaccgccacttcacgcatgttatcgccaaatcggcagactttcagatgacgggtatcctgtttagagaccgcctgacgcatccaggagccgatacgctcatgggcttgtttatcctgccagtgaccggtaaccacggcatgttgctgacgcatacgcgcgccaatgaagccgaactcgcgaccgccatgtgcagtctggttcaggttcataaagtccatatcgatactgtcccacggcagcgccgcgttgaactgggtgtggaattgcagcaacggtttgttgagcatggtcaggccgttgatccacattttggccggggagaaggtgtgcagccacaccaccagaccagcgcaacgatcgtcgtaattcgcgtcgcggcaaatagcggtgatttcatccggcgtggtgcccagcggtttcaacaccagtttgcagggcagtttcgcttccgtattcagcgcattaacgacgtgctcggcatgttgggtgacctgacgcagggtttccgggccatacagatgctggctgccaatgacaaaccacacttcataattatcaaaaatcgtcattatcgtgtccttatagagtcgcaacggcctgggcagcctgtgccggggcggaagttggaagatagtgttgttcggcgctcatcgcccattgctgatagcggcgataaagctgttcaaagcgttgtgcctgctcgctgcacggttgcagggttttctctaccgcactggccattttttgctgagctgatgggatgtctgcgtgcactttcgcggcgacggcagcaaaaatcgccgcaccgagcgcacagcactggtcagaggcaacaatttgcagcgggcgattcagcacgtcgcagcaggcctgcataatgacctggtttttccgcgcgatgccgcccagtgccatcacgttattaacggcgatcccctgatcggtaaagcactccatgattgcgcgtgcgccaaaggcggtggcagcaatcaaaccgccgaacagcagcggagcgtcggtagcgaggttaagatcggtaatcacccctttcaggcgttggttagcgttcggtgtgcggcggccgttaaaccagtcgagcaccaccggcaggtgatccagagacggatttttggcccatgcttcggtcagcgccggaagcagttgtttctggctggcgttgatttgcgttttcagttccggatgctgggcggcaagctgttccagcggccagccgagtacgcgaccaaaccaggcgtagatatcaccaaacgccgattggcctgcttccagaccgataaatccaggcaccacgctgccatcaacctgaccgcaaatacctttaactgcccgctcgccaacgctctgtttgtcggcaatcagaatgtcgcaggtggaagtaccgataacttttaccagtgcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaagtgtcagtgaacagcggggaaggcaaatggcgattgaggatcgggtccagctcatcaaagaaactggctggcggcaggccgccccagctttcgtgccacagagatttatgcccggcgctgcaacgtccgcgacgaatatcctgcgggcgggtggtaccggaaagcagagctggcacccagtcgcacagctcaatccacgatgcggcagattgcgccacggcgctgtcctggcgagtcacatgcaggatttttgcccagaaccattcgctggaataaataccaccaatgtagcgggagtagtcaacgttgcccggcgcgtggcacaaacgggtaatctcttccgcttcttcaaccgcagtgtggtctttccacaatacgaacatcgcgttcgggttttcggcaaactccgggcgcagcgccagcacgtttccgtcggcatcaatcggtgcgggcgtcgagccggtactgtcaacgccaatcccgaccacagctgcgcgctgttcgacgctaagctctgcaagcacggttttcagtgccgcttccattgactcaatgtagtcacgcggatgatgacggaactggttattcggggcatcacaaaattgccctttctgccaacggggataccactctacgctggtggcgatctcttcaccggtagcgcagtccaccgccaaagctcgcacagaatcactgccaaaatcgaggccaattgcaatcgccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttgggttagcgagaagagccagtaaaagacgcagtgacggcaatgtctgatgcaatatggacaattggtttcttctctgaatggtgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacgggtttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgcattagtcaggcgaagctgcttttgagcactacccggatgcctatcgccaccgtcggtcgcaatgttggttttgacgatcaactctatttctcgcgagtatttaaaaaatgcaccggggccagcccgagcgagtttcgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcaagcattgctggaacactttattacccaatccaccgtgtattcattgatggcggtggtgttggtggcctttctggagtcgctggcgctggtcggtttgattctacccggtacggtgctgatggcggggctgggagcgctgattggcagcggcgagttaagtttctggcacgcctggctggcagggattattggctgcttgatgggcgactggatttctttctggctgggttggcgttttaaaaagccgttgcatcgctggtcatttctgaagaaaaacaaagcactacttgataaaactgaacatgcgttgcatcaacacagcatgttcaccattctggtcggtcgttttgttggcccgacgcgtccgctggtgccaatggtggcgggaatgctggatctgccggtggctaaatttattacgccgaatattatcggctgcctgctgtggccgccgttttacttcctgccagggattctggcgggcgcggcgatcgatattcctgccggaatgcagagcggtgagtttaaatggttgctgctggcaacagcggtgtttttgtgggttggtggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttaggagatagtcttgtgcgggttgcctgatgcgacgcttgccgcgtcttatcaggcctacaaaacgcactacccgtaggtcggataaggcgttcacgccgcatccgacagtgcatactaacccgtaatccccaatagtgccgaagcactcgccttaccgctcaacaactcattggtcataccctgccaggcgatgcgcccgtcggcgactactaccgagcgcgtggcgatccgcgccgcatcttccacgctgtgcgacaccatcaatagcgtcattttttgctgctggcagctcgtgctcaccagcgtcaacatctcctgacgtaacgccggatcgagcgcagagaacggttcatcgagcaataaaatcggctgttcgcgtaccagacaacgcgctaacgccactcgctgtcgctgaccgccggaaagctcgcccggtaaccgcgccattaaattatcaatccccatctggcgggcgatagcgtgcattttcccctgctgtaccgcgttcagtttcaatcccggatttagccccagcccgatgttctgtgcgaccgtcaggtggctgaacaggttgttctcctgaaacagcatcgacaccggacggcgtgacggcggcatagttgtgtgatctacgccatcgatagtcagcgaaccgctggctggcgtcagaaaaccggcgatcaaattcagcagggtacttttacccgcgccgcttggcccgaggatcgccacctgctcgccgcgttccaccgttaagctaaaacgcatcggcaaatggtggtaaagccaggtgatatcagtcagttttaacatttcgccccggtagtttttcaatcacggtaaacagcagaaaacagagcagcagcagaattaacgcggtgaccgcaccgtcctggctgcgataggagccaatttgctggtagagataaaacggcagggtgcggaaatcatcgttaccgaacaacgccaccacgccaaaatcaccaatcgacagcacgcatgcaaaggccagcgcctgcgccagtggacgtttcagggcgcgcagctccaccacttttaagcgtgaccagccttcaatccccagcgactgacataacatgctgtagcgggcggtgatatcgcgcatcgggttttccagcactttcagcgcataagggatcgccattaacgcattggtgaaaatcacaatgccgtcagcagattgtggcaggccgatagtgttgttgagcagtaaaaagaagccggtagccagcacaatccccggcatggcgaggatcaacatgccgctcatctccagcacctgacccgccagcattttctgccgcgcccgcagttcgcgactgctccatagcagcatcatggtcagcactacgcacaatacacctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacaccgtgtcgcaaatgcggctatgcagacgatcgtccgggtcgcgccagccttgcagcagcgtggtgccgggcgcaatggccttactcaatcgctgactcaacagcaccagcccgaggcagcacaccatctggagcagcgccagcattgccgcgcgggcaggatcgtagtcgtaactcagcgcctgatagattgccagctcgatagtggtcgcctgcggaccgccccccagcgatagcacggtggcgaagctggcgaaacagagcataaagataagcgcagcaaccggcgggatttgtcgccgtaaccacggccattcgacgaagcggaaaaaatgccagctacgcatcccaagctgggcggcaagttgacgctgttcgccggggatgttttccagtgcctggagtaataagcggctcgccatcggcagattaaaaaacacatgggccagcaaaataccttgcaggccgtagggcgaaaaggtccactccagaccgagcgattggcagagtgttgccagccagccctggcgaccatagacgctaagaatgccgaaaacagcgaccaacaccgggaggatcaaggtcattgcacacagacgcaacagcgccagccgacccggaaagcgcctgcgatagagcgcgcgggcgaggaatatcgcgggtatgacagagagcagtgccgagagaaacgcctgccagaaggagaagcgcaccacatgccacagatagctgtcctgccagactgccacccagtcatcctgcggcgcgttccaccacagggcgagaaacgccgccagcgcaaccgctaccaccagcgtggtggcgcttacacctggaattaaccagccgggaattaacggctgacggcgcgttgccattcgctaatccatgcctgacgttgtgccgccacttcggctggcgtgaactccaacgtggttgcgggtttggtcaatttttcaaaaccggcaggcagcgtgacgtttgccaccggatacatccagttgccggttgggatcgcattctggaaagccggagaaaccataaactggaggaatttttgcgccagctccggctgcttgctggcagcggtgcgggcggcgacttccacttgcagatagtgaccttcgctgaagttcgcggcggcgtagttatctttcttctcttcgagaatgtgataagccggagaggtggtgtaactcagtaccagatcgctttcaccttttaaaaacaggccgtaggcttcgctccagcctttggtgaccgtgaccgttttcttcgccagtttctgccaggcttgtggggcgtcatcgccatagactttttgcatccatagcaacagacccagccccggtgtactggtgcgcggatcctgataaatcacccgccagttttgatcgctctcaaccagttctttcaggctttgtggcgggtttttcagtttgttcttgtcataaacgaaggcgaagtagccataatcaaacggtacgaaagtgtcattattccagccgccgggaacgttaacggcatccgctgccacaccgcttttggcaaacagtccggttttactggcggcgtctaacaggttgttatccagccccagcaccacatcggctttactgtttttgccttccatccgtagacggttgagaagcgaaacgccatcttccagcgccaccagtttcagttcgcaattacagtcggcttcaaaggcttttttaaccaccggaccaggcccccagtcggcggcgaaggaatcgtaggtataaacagtcagaacgggtttagcgaaaacgggcgctgtgcacagcaacagcaggggcagacatttttttaacactttgcacctcaaaaaagagtggcaaaggacttgagaaggagcctcaaatcccttcgccggcgttatccggatcaggttcgacgggtattttctcagcgcacgcgtacgcgtggcaccccgttgagaacggcgttagtgtagtgattttgttatcaaccagcaatcatggatccggtggcgcaaaccacgctgatttaaaatcgaaccagccgagggtattcatgcgcaggccgcgcatactgcgttgcccctgaatgatcagccagtggtgcaataatggcaccatcgctttgctggcgaccagttgctggcaccagttcgccagattcatctcgccattgcgccagcgagcagcgtcggcttgccagtcaatgggaatgcaatgttgtagcagtggcacttcgcataaatgtgcgaaaacagagaagtccagcggcagggtaaagttggcgctgtttagccagatatcactttcgatctctcctgtatgccactgatcgtagtcgatctctttgattttcagcgtgacctggtgacttgccagaatctgctgcatgatcccggcaatcacccgatgctcactgtgatcctgataaaaggttagggtgaggctttccaggccagccggtttttcgctctttatggtgcgggcatggtgccaacgggggagcagtccataagccgggaaccacagttgctggtactgttcctcagcgaaatagaccagattagttggagaaagcacatagcttacccagtccctgacttgctgattcgccccgcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcgaatcaccgcatacggaccggtgccgatgggatggctggcaaagttactgagggtttcccattcgcgcggcaggatcatcgccggaacttgccccagcagtaacggtaaccagcggtccggttgcgtgagatggatatccagcgtccagggcgtcggcgacacaatgtcagcaatatgcgaatagagcggcagcgtattgattcgttttaaagaggcgatcacatcgtccatttccagttcacgaccatggtgaaaatggactcctggacgcaaaaagaaacgccagtgaagcggtgaaatttgctgccagtggtgggcgatgtctgcttccagttccccattttcctcatttatgcgcgttagcgaactgaagatttgccgggcgatatgggtttcggaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcaccagttgatcgatacgatcctgctccagcaggtcttccgcccgctgttgctgaagcgccagcccggtatagaggaatgtcagacgcgagcgtttaccgcgcccgacttccgcttcccacgtcagccagccgcgatcctgcatggtgttgagcagggtgcgcatatgacgacgcgagcagctcaataacgctgccagttcgttgagcgttgtgtcctgcgatttaccctcgcagcattgccacaggcggatgaactgttgttgcagacgagcagatggcataaaaggggaactcctgtgcaaaagacagcaattttattttccctatattaagtcaataattcctaacgatgaagcaagggggtgccccatgcgtcagttttatcagcactattttaccgcgacagcgaagttgtgctggttgcgttggttaagcgtcccacaacgattaaccatgcttgaaggactgatgcagtgggatgaccgcaattctgaaagttgacttgcctgcatcatgtgtgactgagtattggtgtaaaatcacccgccagcagattatacctgctggttttttttattctcgccgcgctaaaaagggaacgtatgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttgatgacgtggacgatagcggaaagcccggtcatttgaccgggcaaggggattaattcataaacgcaggttgttttgcttcataagcggcaatggcgtcgtcgtgctgcaaggtaagcccaatactgtccagaccgttcatcatgcagtggcggcggaaggcatcgatggtaaagcgataggttttctctcccgctttcacctcttgcgcttccagatccacgtcgaaatggatccccggattagctttcaccagcgcaaacagttcgtccacttctgcatcgcttaatttcaccggcagcagctggttgttaaagctattgccgtagaagatgtcagcaaaactcggcgcaatcaccactttaaaaccgtagtcggtcaatgcccagggcgcgtgctcacgcgaagagccacagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccagcggaaccaccaggcctgtgtgtttgataaatttctctgccatggtgtgctccttatttaatgttgcgaatgtcggcgaaatgtccggtcacagcagcagcggcagccattgccgggctgaccagatgcgtgcgcccgccgcgcccctggcggccttcaaagttacggttgctggtggaggcacaacgttcgcccggattcagacggtcgttgttcatcgccagacacattgagcagccaggcaagcgccattcaaaaccggcttcaataaagattttatccagaccttccgcttccgcctgggcttttaccgggccagagccgggaaccaccagtgcctgcacgcctggcgcgacttttcgccctttggcgatctccgctgccgcgcgtaaatcttcaatgcgcgagttggtacaggaaccgataaacactttgtcgatagccacttcggtcagcggaatacccggtttcagccccatataggccagcgctttttctgccgacgcgcgttcaaccggatcggcaaacgaagccggatcgggaatattgtcgttcacggaaatcacctggccgggattggtgccccaggtgacctgcggtgaaatttcttctgcttgcagagtgacaacggtatcgaaagttgcgccttcgtcggtttgcagggttttccagtaggcaacggcgtcgtcgaaatctttgcctttcggcgcatgcagacggcctttgacatagttaaaggtggtttcgtccggtgcaaccagaccggcttttgcgcccatttcgattgccatattgcacagggtcatacgaccttccatgcttaaatcacggattgcttcgccgcaaaactccaccacatgcccggtgccgcctgcgctaccggttttaccgataattgccagcacgatatcttttgcggtaatgcccggcgcggctttgccctggacttcaattttcatggtttttgcgcggccctgtttcagggtttgcgttgccagtacgtgttcaacttcggaagtgccgataccaaaggccagtgcgccaaacgcgccgtgggtggcggtatgcgagtcgccgcagacaatggtcatccccggcaaggtgacgccctgttccggccccattacgtggacgatcccctgatacgggtgattcaggtcatacagttcgacgccaaattctttgcagtttttgatcagttcctgcatctggatacgcgccatttcaccgcaggcattaatgtctttggtctgggtagagacgttgtgatccatggtagcgaaggttttgcccggctgacgtaccgggcgaccgtgggcgcgcagaccatcgaacgcctgcggtgaggtcacttcatgcaccaggtggcggtcgatatataacagtggggtttcgttttcggcttcgtacacaacgtgagcgtcgaacaatttttcgtataacgtcttagccatgattacaccccttctgctacatagcgggcaatgatatcgcccatttcatcggtactaacggcggcagcgccacgggctaaatccccggtgcgaatgccttcttctaatgcgcggttaatggcgcgttcaatggcgcaagccgcatcatcggcatccaggctgtaacgcagcagcagtgccagcgaaaggatttgtgcaatcgggttggcgatgtttttgcctgcgatatctggtgccgagccgcccgccggttcatacagtccaaaaccttgctcgttcaggctggcggaaggcaacatccccatcgagccagtgatcattgcgcactcgtcagacagaatgtcgccaaacaggttggagcacagcagaacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttatcgatcgacgtcactttgtggcgacgcttgcgagcagattcaaacgcgatgcgggcgatacgttcgatctcaaaacggtgatacacctcggtatcaaaggctttttcatattgtccgctaccttcgcggccttttggctgaccgaaatagatgccgccggtcagttcgcgcacacacaggatgtcgaagccgtttgcggcaatgtctgcacgcagcggacagaatgcttccagcccctgatacagttttgccgggcgcaggttgctgaataatttgaagtgcttacgcagaggcagcagcgcgccgcgttctggttgctggtctggtggtaaatgttcccacttcgggccgcctaccgagccaaacagcacggcatcggcttgctcacaaccttcaaccgtcgcaggcggcagtggttgcccgtggttatcaatggctgcgccgcctacatcgtaatggctggtggtgatgcgcatcgcaaagcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagaacgtgcaccatggctttggcagatgactcgacaatatcggtagccaggccgacgccgtggaagcggcgaccgttgtagttagcgacgatatccacctgacccagcgcatctttaccgtggcctttggcggtcaggctgtatttcaccagttcgacgttatattcagtgatgcggttaattgcctgatagacggcatcgaccggaccgttaccgttggcggcttctgctttgacttcttcgccacaggccagtttgacggcggcggtggcgatatcgttagagccagactgcacgctgaagtaatccagacggaaatgctccggctcttcttgctgcttaccgatgaaggccagcgcctccagatcgtaatcaaacacctgaccttttttgtccgccagcttcaggaaagcatcgtacaaattgtctaaattatattcactttctttataccccatctcatccatgcgatgtttcaccgccgcacgccccgaacgagaggtcagattcagctggatttggttcagaccaatagattctggtgtcatgatttcgtagttttcgcggtttttcagcacgccatcctggtgtataccggaggagtgtgcgaatgcgccgctgccaacaatggctttgtttgccgggatcggcatattacaaatctggctaactaactggctggtgcgccatatctcctggtgattaatggcggtgtggacgttgagaatatccttacgaactttgatcgccatgatgacttcttccagggaacagtttccggcacgctcgccgatcccgttcattgcgccttccacctggcgtgcaccggcatgtaccgccgccagtgagtttccgaccgccaggcccaaatcgtcgtgggtatgtacggagataatggctttgtcgatgttaggcacgcgttcatacaggccgctgatgattccggcgaactcaaacggcatggtgtagcccacggtgtccggaatgttgatggtggtggcaccggcattaatcgccgcttcgaccactcgcgccagatcggcaatgggtgtacgcccggcatcttcgcaagaaaattcaacatcatcggtgtaattacgggcgcgtttcaccatatagatagcgcgttcgatcacctcgtccagcgtgctgcgcagcttggtggcgatgtgcattggcgaagtggcaataaaggtatgaatacggaaggcttcggcgactttcagggattcggccgccacgtcgatatctttttccacgcagcgagctaacgcacatacgcggctgtttttaacctggcgggcgatggtttgcaccgattcaaaatcgcccggcgaagagacggggaaaccgacttccatcacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcatccagagacggcggagttaagcaaaccacagctacgcatggtcgatctcaacttattaaccgttttcgatgccgtgatgcaggagcaaaacattactcgtgccgctcatgttctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagcgtaccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaacagcagaacctgttatctctcctggcatgaagctgccgggcgcgataaaggccatcagtggatggaagagcaattagtctcaatttgcaaacgctaactgattgcagaataggtcagacatgaatgtctggtttattctgcattttttattgaatgtagaattttattctgaatgtgtgggctctctattttaggattaattaaaaaaatagagaaattgctgtaagttgtgggattcagccgatttattatcaatttaatcctctgtaatggaggattttatcgtttcttttcacctttcctcctgtttattcttattaccccgtgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttgatgcatttttagcatcgattcgcgatgtggcgaaaattgtggaggttgctcgctctggtgtggtcggactttcgcgcggcgataaaataatgcgttgagaatgatctcaatgcgcaatttacagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcagaagatcagccagacaacgaaatgcggtgcattgagcaccttttacagcgtcaggttgatgccattattgtttcgacgtcgttgcctcctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggtgcgctaccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggagtgatggatgtcacgctgcgtcgcgacggcaaactgccttctgacctggcaattgccacctttggcgataacgaactgctcgacttcttacagtgtccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggcgtgctcagccgtagctaagccgcgaacaaaaatacgcgccaggtgaatttccctctggcgcgtagagtacgggactggacatcaatatgcttaaagtaaataagactattcctgactattattgataaatgcttttaaacccgcccgttaattaactcaccagctgaaattcacaataattaagtgatatcgacagcgcgtttttgcattattttgttacatgcggcgatgaattgccgatttaacaaacacttttctttgcttttgcgcaaacccgctggcatcaagcgccacacagacgtaacaaggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctcagctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacatttatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgaacgtggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgctgcaacgccggtgaaagataagtttaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcactaggcaagttaatgccgggcgaagaagaggtggctgagaaccctcgtgcccgtagttcagttctgcgtattgcagagaggacgaatgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgactgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacctggcgctgagtattgatgaacgcctgcaggcgctggtttatcgcgaactgaacaacgcggtggcctttaacaaggctgaatctggtagcgccgtgctggtggatgtcaacaccggtgaagtgctggcgatggctaacagcccgtcatacaaccctaacaatctgagcggcacgccgaaagaggcgatgcgtaaccgtaccatcaccgacgtgtttgaaccgggctcaacggttaaaccgatggtggtaatgaccgcgttgcaacgtggcgtggtgcgggaaaactcggtactcaataccattccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccattacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccaggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgatggtgaaatccgtgaaatgcacggcgtaccggtcatctatctcagccagctcaacgagcgtttatctgcactggcgggccgcttttaccatgaaccctctgacaatttacgtctcgtgggcgtaacgggcaccaacggcaaaaccacgactacccagctgttggcgcagtggagccaactgcttggcgaaatcagcgcggtaatgggcaccgttggtaacggcctgctggggaaagtgatcccgacagaaaatacaaccggttcggcagtcgatgttcagcatgagctggcggggctggtggatcagggcgcgacgttttgcgcaatggaagtttcctcccacgggctggtacagcaccgtgtggcggcattgaaatttgcggcgtcggtctttaccaacttaagccgcgatcaccttgattatcatggtgatatggaacactacgaagccgcgaaatggctgctttattctgagcatcattgcggtcaggcgattattaacgccgacgatgaagtgggccgccgctggctggcaaaactgccggacgcggttgcggtatcaatggaagatcatattaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcggcgcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaagctgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgactgcagcagtccaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaattactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgccgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgcgatttctgccgataacccggaaattgtcgccgctcatgaagcgcgtattccggtgatccgtcgtgccgaaatgctggctgagttaatgcgttttcgtcatggcatcgccattgccggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtggggcgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggcattgacgacgaggctattttgcgggcgcttgaaagcttccaggggactggtcgccgttttgatttcctcggtgaattcccgctggagccagtgaatggtaaaagcggtacggcaatgctggtcgatgactacggccaccacccgacggaagtggacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggatccggcgcgggtagccgagatgctggcaccggtattaaccggtaacgacctgattctcgttcagggggctggtaatattggaaaaattgcccgttctttagctgaaatcaaactgaagccgcaaactccggaggaagaacaacatgactgataaaatcgcggtcctgttgggtgggacctccgctgagcgggaagtttctctgaattctggcgcagcggtgttagccggactgcgtgaaggcggtattgacgcgtatcctgtcgacccgaaagaagtcgacgtgacgcaactgaagtcgatgggctttcagaaagtgtttatcgcgctacacggtcgcggcggtgaagatggtacgctgcaggggatgctcgagctgatgggcttgccttataccggaagcggagtgatggcatctgcgctttcaatggataaactacgcagcaaacttctatggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaacagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacacgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaataccttcagcgtgccgccagaacgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccacggagtctgcaacgtcagacactggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcagcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtggactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggctacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatatgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcacgccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggaaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaacatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctcaatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgcagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgttggatgtcagcgatgtgagcgaaaccattaacagcattcgtgaagatgtgttcaaagcgaccattgatgcctacattccaccacagtcgctggaagaaatgtgggatattccggggctgcaggaacgtctgaagaacgatttcgacctcgatttgccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaacgcttgactccctgtggaaagagcacctggcagcgatggactatctgcgtcagggtatccacctgcgtggctacgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggagagcgcaaagtaggacgtaacgatccttgcccgtgcggttctggtaaaaaatacaagcagtgccatggccgcctgcaataaaagctaactgttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggtgaaacgccggaacaggcggtggtgcgtgaacttcaggaagaagtcgggattaccccccaacatttttcgctatttgaaaaactggaatatgaattcccggacaggcatataacactgtggttttggctggtcgaacgctgggaaggggagccgtggggtaaagaagggcaacccggtgagtggatgtcgctggtcggtcttaatgccgatgattttccgccagccaatgaaccggtaattgcgaagcttaaacgtctgtaggtcagataaggcgttttcgccgcatccgacattcgcacacgatgcctgatgcgacgctggcgcgtcttatcaggcctaaagggatttctaactcattgataaatttgtttttgtaggtcggataaggcgttcacgccgcatccgacatttgcacaagatgcctgatgcgacgctgtccgcgtcttatcaggcctacgtgcggcatcagacaaatgtcactgctttggttcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttccggtacctgtccgttttcagtgtccagcggcataaaacgaatggcaaaacggctcttatgtccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtgagcgggttcaggctggcaatccaggtttctacctggctgtcgcgctgcgcctggggtagatgcagccaaatgtgcaatgtaggtaaatcaaagctgcaacagccgcctgggatgctcagtcgctgacgcaccagagcaatcaaacgatcttcacgcagaaattgcccgatacgcggcgcggaaattaatacgctccccgccgcttttaactgctgaattaatgcttcaatacggctctggtccacgccaggcacgccaatccaggtctggagtttacgttgctgccggtcaagttctttcaacagctcagtgcggacttcgccgcgctcgaaaacatccagtaattcactgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgggcttcgcgcgttgcctgagcagcaaggatttgttcgacatgctcgcgagttacatcatcgcgctgcatggtgcgcttaagttgcgtttctgggctgacatccaccacaagcactcgattcgcttttttatacagtgagttttctaccagcaatggcacaacccacagtacatagggggaagtagcttgctggatctggtgttgcgtctcttgctgaatcagcggatgcagcagggcgttaagccagtttttctcttccgggttggcgaagatccgctcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagatcagcaaacgcattggcaacggtactcttgccactgccaatgcctcccgttaaggcaactatatacctcataatttatattcccgggaattcatcatgattatcaaaacgttaaaaatgagtgcacgaaagcgaaattgatgaaacgttcgctcactatttaccaggtaaatttatgggattgtagcgtaaaaaaagacaatttcgcagtcttgcgccgcattgattagtgcgtatgatagcgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagctggtccggcgtgccgattatcgccgcaaatatggacaccgtaggcacattttctatggcctctgcgctggcttcttttgatattttgactgctgtgcataaacactattctgtcgaagagtggcaagcgtttatcaacaattcttccgctgatgtgctgaaacatgtgatggtttctaccggtacgtctgatgcggatttcgaaaaaactaaacagattctcgacctgaacccggcattaaacttcgtttgtattgacgtggcgaatggttattccgaacacttcgtgcagttcgttgcgaaagcgcgtgaagcgtggccgaccaaaaccatttgtgctggtaacgtagtgactggtgaaatgtgtgaggagcttatcctctcaggtgccgatatcgttaaagttggcattggcccaggttctgtttgtacaactcgcgtcaaaacaggcgtcggttatccgcaactttctgcggtaatcgaatgtgccgatgctgcgcacggtctgggcggaatgatcgtcagcgatggtggctgcaccacgccgggcgatgtggcgaaagcctttggcggcggtgccgatttcgtcatgcttggcggcatgctggcgggccacgaagagagcggcggtcgcatcgttgaggagaacggcgagaaatttatgctgttctacggcatgagctccgagtctgcgatgaaacgtcacgttggcggcgttgcggaatatcgcgcagcagaaggtaaaaccgttaagctgccgctgcgaggcccggttgaaaataccgcgcgagatattttgggcggcctgcgttcagcttgtacatacgttggggcttcacgcctgaaagagctgaccaagcgcaccacgtttattcgtgtgcaggaacaagaaaaccgcatcttcaacaacctgtaatctcccaacgctggcgtggagcaacacgccagcgttatcccatcccactcatcgcatcgcctaaatggaaaattggcagatacattgccaccaccagcgtaccaataattcctcccgttatgatcagcaacgccggttccagtaaggctgcgaggttatccgccagcgccattgtgttttcccgatgatgatgggcgaggttgtctaacatgagatccagagagccggatgcctctcctgttctcactaattgcaaacagagcgggctaaactcaccggtattttttagcgccagccagatgggttgaccgttactgatatcgtgctggatttgtgtcagaagttgcacccagtacgggcagcgcattgtttctctgacgctctctacgccctgtaaaaaagtaatgcctgcactttgtgtcagcgccagaatcgtaaagatctgcgtgagtttttgtccccgcatcagtgaacccataatcgggatgcgtaacagcaatttctgccgcactataagccaggtcggtcggcgcatcagcaacttattggctatcgccagcagaaagccgaacaacaccagcagccagctccattcgccactaaagtctgccagcgtcatgatcccctgcgttagtgccggtagtggggtgttgaaggtcttatagatagcggcaaactccggcagaacaaaatgcagcattgccacaaccaccatgattgccatcgctaaaatgatgatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaagcaatgccctgttcgagatcgtgcgccagcgattgcagcaacgcttgccattgcttactgggatgctgttccgccagcagagccagcccttcagaaagcgttaaccctgctttgagtagcgtcgccagttgatgaatgacttccgcgcttttatctcctcgccactgcgcagaattgatggcgattcgcttcaggcttagtggggtaaccatctgttgctgtagtgccataagcagtaaagtacggctctctgcccatagcatcccatcttgcgcattgccgtcgccggttatgccatgccagcgccagagttgcttactcgccatgcggcatccccagtacgcggattaactcttcaaaggtggttaagccttgctctacggccaggcagccgttttcaaaaagcgtacgcatacccgcctgtcgtgcgtgcgtttccagcgattcaacgtcggtattagcggaaataagctgacgaatgaccggcgttatgggcagaacttcaaataaggccgtacgaccataaaaaccgtggtagcaatgtacacaaccgggtgcctgccagtggggcagcggcgatggccatacattgtctggaatgtggatgggctccccttgctgccggcgacaatgtgggcaaagtttgcgtaccagacgctgggctattaccagcgtaagcgccgatgatagcatccagcgggcgacccccatttgctgtaaacgtaccagcgtttcgcaggtggaattagtgtgtagggtagacaacaccaggtgaccagtttgcgccgctttaatagcgatctctgctgtttcgccatcgcggatctctccgatcatgatgacgtcaggatcctggcgcaataacgcacgcaaaacgccctgaaaggtgagtccggcacgcggatggatttgcgtctggtttagtccggctatggggatctcaactggatcttcgacgctacaaatattaatgtcagcggtattcagcttttgcagggcactataaagcgtgaccgttttgccgctgccggtagggccagttaccagcaccagtccctgtggttgttgcaaggcatgagcaaagtccgccagttgtaacggctgcattccaagcgtgttgacatccagtgcctgacccacctgctgtaacaaccttaataccaccttttcaccaccccgacatggtaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacatccggtaaaggatgcaatacgccgtcgatacgcaagcggatgcggtaggcattgtccgctggttcgatatgaatatcagacgcgcgttgttccagcgcagattgtaacgttcgagttagcaactctgctttgggctgatgcttctcctgaacagctacgggcaatgtctgttgtgtgcgactggcgtgaccttccatttgttggcgcgtccagcaggtgatctcaatacgtttggtggtagcgaaatgcaatgcgtccagtagctcatgcgaaggtgcatcgactaccgcaacatgaaccacctcttcgctggcatccagcaagactccatgataacgcagacacagggcagtgagctgtggaatattcattgccgctccttagttggcgtcatcaaagcggaagacatcttcgcaggcttgctgcaatgcgctgtcactttgaatattgcagttgcgcgtccagccggtgacgccgtttgcgttatcccaacccggtgtcatgacgacgcttagcccattgagactttcttgcccggtcagcgacaccacgccctttgccacactcatggctgaaacatagcgggtggtggtaggcgagggaatgccattgctgccaccgtcgcaggtatctaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaggcgaggggcaaaaaacgaaacgggaaagcagattccgaggttttttatttcgttgcagcgaaagacaagaaatttgcgaggcgttacgaagaaagttggggaaggggagattatccgcccgcgatggagcggataaatctgtcaactattagcgaaaacgcattgaaaggtcgagtgcttgtacgtgtttagttagcgcaccgacggagataaagtccacgcccgtttcggcaaattcacgcagtgttttgtcagtgacgttgccagacacttccagtagcgccttgccgttggtgcgtttgacggcttcgcgcatctgttctgtttcgaagttatccagcatgatgatatcggctcctgctttcagggcttcatcaagttcttccagattctctacttcgacttctactggcgcatccgggtgcagccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacaactgcgtgttggtgccttccagcaattcgacatagtggcgtaccttactggcaactcctgaaagggtttgcacaaaattaagcgcagtgcgttcgcccgttaacagcacgcgggatgggccttcaagttcgaacaaggattgattggcattgatgacatcgccgtcatccacatgccagattatggtgacatcgtcgcctgccagttgaataaacacctcttcaacccagcgtttgccgcaaaagacgccattctcgcgggtgatcaccgtggcatgagagcgagaattttccggtaaaagttttgccgtaatatcattgttggcatcgactgttccgcctaaatcttcccgcagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggttggcgcgcgccgcgttccctcaccacattacgattgccgcccggatgacgaaacacccaccctgctggtggtgcacaatattagcctgccgccaggcgagtttggcggtccgtggatcgacgcattattcactggaactattgatccgcaggcacatcctttctttgctgagatcgcccatttgcgcgtctccgctcactgtttgattcgccgtgatggtgaaatagtccagtatgttcctttcgataaacgtgcatggcatgcgggagtctctcagtatcaggggcgcgaacgctgcaatgatttttctattgggattgagcttgaaggcaccgatacgctggcgtataccgatgcgcagtatcaacagcttgcggcggttacgcgggcactgattgattgctatccggatatcgctaaaaacatgacgggccattgtgatattgcgccggatcggaaaaccgatcccggtcctgcatttgattgggcacggtttcgtgtgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttaggcatgaccattattgcgatgggcgtgacttttttactgttacgcgcattgcagggagtattgttcaacgttcccacgctactggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgacgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgatatcagacgccgcatcatcgtttacagtccggcattgatgccgtgcttcatgtactggattgggtgccggttcgtcttgcgggtgtggtatatgccttgatcggtcatggtgagaaagcgttaccggcctggtttgcttcgctgggtgatttccatacttcgcagtatcaggtgttaacgcgtctggcgcagttctctctggcgcgtgaaccgcatgtcgataaggtggagacgccgaaggcagcggtttcaatggcgaagaaaacctcgttcgtggtcgtggtggtgattgcactactgacgatttacggggcgttggtgtaaagattattgccctcaccctgtacgggtgagggcgtagagagattaatgcgcttttacggctttggcggttttctctttaaacagatagccgatacctaacacgatcagccataccgggatcaggtataccgaaatcgccattcctggggtcatcagcataatcaccagtaccgccgccataaacagcaggcagatccagttacccagcggataaagcagagcagggaagcgagttaccacgccttgttcctgcttggcgcgacggaatttcatatgcgccaggctaatcatcgcccagttgattaccagtgcagataccaccagcgccattaacagtccgaaagcggactctggggcaaggtagttaatcagtacgcacaacgccgttaccagtgcagacaccagaatggtatttactggtacaccacgtttatcgacagacgccagcgcttttggcgcattaccctgttgtgccagaccaaacagcatacggctgttgcaatatacgcagctgttgtacacggagagcgccgcagtcagtaccacgatgttcagcgcattcgccacaaaggtatcgcctaactcgtggaagatcagcacaaacggactggtatcggcggtaacgcgggtccacggcatcagtgagagcagaacggctaacgaaccaatatagaaaatcaggatgcggtagataacctggttagttgctttcggtatactttgctccgggttatcagcttctgctgcggtgatccccaccagttccagaccaccgaacgagaacatgataatcgccatcatcatcaccagcccggtgaagccgtgcggcaggaaaccaccctgatcccacaggttgctaacggtcgcctgcgggccgccgttgccactgaatagcagccagccgccgaagatgatcatcgctaccaccgcgataactttgataatggcaaaccagaactccatctcgccaaacactttaacgttggtcaggttgatggcgttaatcaccacaaagaatacggcggcagaaacccaggtggggatttccggataccagaactgaatgtatttacccacggcagtcagctcagccatggcaactaaaacgtacagtacccagtagttccagccagaggcgaaaccggcaaaactgccccagtatttataagcaaagtggctaaaggagcctgcgacaggttcttcgaccaccatttcacccagctgacgcatgatcagaaaggcgataaaaccagcaatggcgtaacccaggataatccctggccctgcggactgtattacggaggcgctacccaggaataacccggtccctatcgcgccacccagcgcgataagctgaatatggcggtttttaaggccgcgctttagctgctcgccgtgctgttgaccttccatcatgaaacctcgtgcggtggttgtttttttgatctacgcagtgatgcgtgtgtaagtttgcaattccgtttgttgtattaatttgtttacatcaaagaagtttgaattgttacaaaaagacttccgtcagatcaagaataatggtatgcggcagcgaatgcacccgctttatgcatggttgaagatgagttgcttaaaaagaaaccgtttgtaaagctcagcctcaacccctctcaatatgtagaatgaatttaaattcgttttaattgaattaaaaatcacaaaattggtaagtgaatcggttcaattcggatttttatagtttaataatcgttaaaaaactcctttcctacgtaaagtctacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctccttgcgtgaggcgattcaacgtctcgaagcgaagggcttgttgcttcgtcgccagggtggcggcacttttgtccagagcagcctatggcaaagcttcagcgatccgctggtggagctgctctccgaccatcctgagtcacagtatgacttgctcgaaacacgacacgccctggaaggtatcgccgcttattacgccgcgctgcgtagtaccgatgaagacaaggaacgcatccgtgaactccaccacgccatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagtcgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaaaataccgacggatagaacgacccggtggtggttagggtattacttcacataccctatggatttctgggtgcagcaaggtagcaagcgccagaatccccaggagcttacataagtaagtgactggggtgagggcgtgaagctaacgccgctgcggcctgaaagacgacgggtatgaccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaatttttcgtttgccggaacatccggcaattaaaaaagcggctaaccacgccgctttttttacgtctgcaatttacctttccagtcttcttgctccacgttcagagagacgttcgcatactgctgaccgttgctcgttattcagcctgacagtatggttactgtcgtttagacgttgtgggcggctctcctgaactttctcccgaaaaacctgacgttgttcaggtgatgccgattgaacacgctggcgggcgttatcacgttgctgttgattcagtgggcgctgctgtactttttccttaaacacctggcgctgctctggtgatgcggactgaatacgctcacgcgctgcgtctcttcgctgctggttctgcgggttagtctgcattttctcgcgaaccgcctggcgctgctcaggcgaggcggactgaatgcgctcacgcgctgcctctcttcgctgctggatcttcgggttagtctgcattctctcgcgaactgcctggcgctgctcaggcgaggcggactgataacgctgacgagcggcgtccttttgttgctgggtcagtggttggcgacggctgaagtcgtggaagtcgtcatagctcccatagtgttcagcttcattaaaccgctgtgccgctgcctgacgttgggtatctcgtgtaatgactggtgcggcgtgtgttcgttgctgaaactgatttgctgccgcctgacgctggctgtcgcgcgttggggcaggtaattgcgtggcgctcattccgccgttgacatcggtttgatgaaaccgctttgccatatcctgatcatgatagggcacaccattacggtagtttggattgtgccgccatgccatattcttatcagtaagatgctcaccggtgatacggttgaaattgttgacgtcgatattgatgttgtcgccgttgtgttgccagccattaccgtcacgatgaccgccatcgtggtgatgataatcatcattgtcatgatgatgatggtcatgatcgtcgtcgtcccagtcgatgctgctgaatagtgcgtacgtggtagcaacgcccatgctatagccgaatccgcgtacaaagctgtcaacaaacggttctccggctggtggtggcagataaaccggcggatacgcagtattggcccagttcccgtaaaccacggttgggttgtagttgggaatatagaccacatcaggattggcgggctcaatggaaatgacggttgttgccggctctgtaatgacggggttggcagttaaaactgtattggatggtatgacgggtgccgtgactgtctgttttaccggtacagctttcttcgttgtggtaataactttctgttcggttgatgacttcagcgagccggtttgttgcgccagttgccgcaatcgctgtaccgagtccatcacgtcctgcggctgggccagaaaagcatcgcccaggttttgcacccattgcgggttttcgcccatcaatgccatcaattgtggaaaggccaccagtgatttaacgctggcgtcccacggctggtcagataccgcctgaatagcagcatcgccttgtttaagtggattatcgtgcgaccattgcactgcttgagcaacgtttgtcggataggttgatgccatcagcacctgcgaaagtagggcgtcgggatacagcgcgacgggcgcgacccattgatctatttgtgcagtgctgaatgcggatttgacgacggcgggtgttacgggaggtgcggaaaccgttgcaggaaacgtaaccgcggcagcgtcagacacagccagttgtgtcgattgcggttccacaggcgcttccactgtgcggctttttatatatagcccggtagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggcggtagtttaaattttgactaatcttgggattcgttgagaaaggtgattatcaccatgcgaattaacgaagtttttacggagggaaacaatctctagaccatccttaacgattcagccacttttttatgttgcttttttgtaaacagattaacacctcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttcccccaggcgtcgatgaagccgcctatgtcaaagcaggcttcctggctgctatcgcgaaaggcgaagccaaatcccctctgctgactccggaaaaagccatcgaactgctgggcaccatgcagggtggttacaacattcatccgctgatcgacgcgctggatgatgccaaactggcacctattgctgccaaagcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggcgatgatattccacatgtgccgaacaaacgcggcggtggtttgtgcctcggcggtaaaattgcacccatcttctttaacacgatggaagacgcgggtgcactgccaatcgaagtcgacgtctctaacctgaacatgggcgacgtgattgacgtttacccgtacaaaggtgaagtgcgtaaccacgaaaccggcgaactgctggcgaccttcgaactgaaaaccgacgtgctgattgatgaagtgcgtgctggtggccgtattccgctgattatcgggcgtggcctgaccaccaaagcgcgtgaagcacttggtctgccgcacagtgatgtgttccgtcaggcgaaagatgtcgctgagagcgatcgcggcttctcgctggcgcaaaaaatggtaggccgtgcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtcattcactcctggctgaaccgtatgctgctgccggataccgtcggtaccggtggtgactcccatacccgtttcccgatcggtatctctttcccggcgggttctggtctggtggcgtttgctgccgcaactggcgtaatgccgcttgatatgccggaatccgttctggtgcgcttcaaaggcaaaatgcagccgggcatcaccctgcgcgatctggtacacgctattccgctgtatgcgatcaaacaaggtctgctgaccgttgagaagaaaggcaagaaaaacatcttctctggccgcatcctggaaattgaaggtctgccggatctgaaagttgagcaggcctttgagctaaccgatgcgtccgccgagcgttctgccgctggttgtaccatcaagctgaacaaagaaccgatcatcgaatacctgaactctaacatcgtcctgctgaagtggatgatcgcggaaggttacggcgatcgtcgtaccctggaacgtcgtattcagggcatggaaaaatggctggcgaatcctgagctgctggaagccgatgcagatgcggaatacgcggcagtgatcgacatcgatctggcggatattaaagagccaatcctgtgtgctccgaacgacccggatgacgcgcgtccgctgtctgcggtacagggtgagaagatcgacgaagtgtttatcggttcctgcatgaccaacatcggtcacttccgtgctgcgggtaaactgctggatgcgcataaaggtcagttgccgacccgcctgtgggtggcaccgccaacccgtatggacgccgcacagttgaccgaagaaggctactacagcgtcttcggtaagagtggtgcgcgtatcgagatccctggctgttccctgtgtatgggtaaccaggcgcgtgtggcggacggtgcaacggtggtttccacctctacccgtaacttcccgaaccgtctgggtactggcgcgaatgtcttcctggcttctgcggaactggcggctgttgcggcgctgattggcaaactgccgacgccggaagagtaccagacctacgtggcgcaggtagataaaacagccgttgatacttaccgttatctgaacttcaaccagctttctcagtacaccgagaaagccgatggggtgattttccagactgcggtttaaaaagtcagcgcacgcgctgcgcataaacgacacaatgcccggtgaatgagattcccgggcatttttttatttctaaaccatcgccgttccgctgtttttctccggtaaggctgcgataattacatcaatggcgcaatgcgatttcggtgcattgccgggagcagaggaacacactatggattacgaatttctgcgcgatattaccggagtggtaaaggtgcgtatgtccatggggcatgaagtggtcgggcactggtttaatgaagaggtgaaagaaaacctggccttgcttgatgaagtggaacaagcagcgcacgcactgaaaggtagcgaacggtcctggcaacgggcagggcatgaatacaccctgtggatggacggtgaagaggtgatggttcgcgccaatcaactggaattcgctggcgatgaaatggaagaggggatgaactactacgacgaagaaagcctgtcgctatgcggcgttgaggattttctgcaggtcgtggcggcttaccgcaatttcgtgcagcagaagtaaataaatctggcggagcctgggagctccgccagagccgttaaacagctggcatattgcgcccgtaataaatctcgcgcatttctttccacagcgcagcggtaatttcctggcgctcgctgtcggttaagtcttccggtttggtgtggaacatgtagtgcttaaggtcgaactctttaagcaacatcttggtatggaagatattttcctgatagacgttcacatccaccatgtcatacagcgccttcatatcgtcagacataaagttctgaatcgaattaatctcatggtcgataaagtgcttcataccgttaatgtcgcgggtaaaaccgcgcacgcgataatcaatggttacgatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcaagatgggcaacgaccgtttctggcagtgggccggggtgttctgttttgtcgatgagtttcgggtcaaccggttcttcactcaccagaatagtgacgctggcaccctgtggttcgtaatcctggcgggcgatgttaagaatattagccccgataatggaacaggtttctgacaggatttcggtcagacggttggcattatagagttcatcgatataagcaatataaccgtcgcgctcttcggcagttttggcgtagcagatatcgtaaatacaaaaactcagacttttggtcagattattaaagccatgcagtttcagttttttcaatttcttatcttctccttaggacggctgtgaagccagtgcgtcttgcagatactgaggtaaggcaaaagctgccgtatggattgccggattgtaataacggcatttcaggccagaggcgagaaaacgcgcctgaataatttcggttgagagatggcgtaaggcgtcgttatctgtcgcccatgcaaaagtcatgataccgccgtaataggtcgggatcgccgcctgataaaagccaacgtcgctgaagtaatggctgagtttgcgatggctgtcgatggcttcttcctgctgtaaaaagcagacgccgttttgtgcgacgaagataccgccaggattcaggcaacgtttgcagccttcataaaatgccgaagtgaaaaggctttcgccgggaccgataggatcggtgcagtcggagataatgacatcaaaggtctggctggtttgattaacgaaattgacgccatcgtcgatcaccagcttaaagcgcggatcgtcgtagctaccggcgttatggttgggtagatactgacggcagaacgatacgacacccgcatcgatttccaccatcgtgattgactcaacgtttttatgtcgggttacttcacgcagcatggcaccgtcgccgccgccgataatcagcacatgtttcgcgtgaccatgggccagtagcggaacatgggtcatcatctcatgatagataaactcgtcgcgctcggtggtttgtactacgccatccagcgccattacgcgaccaaatgcagcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaagggcgcaacataatagctaacattgaccgcggatgcacggtcaatatttctacaaaaaggtatcagggattatttgacgtaggcaagcaggcttaaggaatcgcgggccagggctttgcattttttagcgacgggaatgccaatgccgctgagatcgcggtagctgtcttcaccgagggctttcatgtcgaaggtgtcgtaattactgaggtcccactggttttgctgagcgaaaaagaccagtgcgcgacgaatttgcccgttaggtaagttctggtaaccacaatcgttcttcagaaagacaaaaactgccgttaaatcggccatatcttcggcttcagactcgctgagcgcgtaactgtttgcgcagacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttaaaatattccgtcgcgctgggtgtggcttcggctttgccgctgtggagccgcgcagtatttgcggcagaacgcccaacgttaccgatccctgatttgctcacgaccgatgcccgtaatcgcattcagttaactattggcgcaggccagtccacctttggcgggaaaactgcaactacctggggctataacggcaatctgctggggccggcggtgaaattacagcgcggcaaagcggtaacggttgatatctacaaccaactgacggaagagacaacgttgcactggcacgggctggaagtaccgggtgaagtcgacggcggcccgcagggaattattccgccaggtggcaagcgctcggtgacgttgaacgttgatcaacctgccgctacctgctggttccatccgcatcagcacggcaaaaccgggcgacaggtggcgatggggctggctgggctggtggtgattgaagatgacgagatcctgaaattaatgctgccaaaacagtggggtatcgatgatgttccggtgatcgttcaggataagaaatttagcgccgacgggcagattgattatcaactggatgtgatgaccgccgccgtgggctggtttggcgatacgttgctgaccaacggtgcaatctacccgcaacacgctgccccgcgtggttggctgcgcctgcgtttgctcaatggctgtaatgcccgttcgctcaatttcgccaccagcgacaatcgcccgctgtatgtgattgccagcgacggtggtctgctacctgaaccagtgaaggtgagcgaactgccggtgctgatgggcgagcgttttgaagtgctggtggaggttaacgataacaaaccctttgacctggtgacgctgccggtcagccagatggggatggcgattgcgccgtttgataagcctcatccggtaatgcggattcagccgattgctattagtgcctccggtgctttgccagacacattaagtagcctgcctgcgttaccttcgctggaagggctgacggtacgcaagctgcaactctctatggacccgatgctcgatatgatggggatgcagatgctaatggagaaatatggcgatcaggcgatggccgggatggatcacagccagatgatgggccatatggggcacggcaatatgaatcatatgaaccacggcgggaagttcgatttccaccatgccaacaaaatcaacggtcaggcgtttgatatgaacaagccgatgtttgcggcggcgaaagggcaatacgaacgttgggttatctctggcgtgggcgacatgatgctgcatccgttccatatccacggcacgcagttccgtatcttgtcagaaaatggcaaaccgccagcggctcatcgcgcgggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattaaactgatgacaaacgcaaatctgcctgatgcgctacgcttatcaggcctacgctagctgtgcaatccattgattttgcacaattttgtaggctggataaggcgttcacgccgcatccggcatgaacaacgcgcacgttgtcagcaatctgagcaagtcttacttcacatcatccggcagcgcataagccacaatatagtcgcccatcttcgtaccaaatgaaccgtgaccgcctgcggagatcaccacatactgcttaccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgcccagcatcggcatacccatattgaacggcaccggaaccggcatcgggaacggcatactgtcctgcggcgtaccaatacgtttcttccacaccacttcattagttttcagatccagcgccgagatataaccccatgctggctgtttacatggcagaccaaatggtgagaggaacgggttgagcgtgacaccatacggtacaccgtactgtggctgaatgccggattccgtacccgtgcctttggcatctttcggctgctccatcgggttgccaggaccacgcgggatcagtttcgaaacaaacggcagtgccattgggttggcaatcgccacttcacgatttggatcaacggaaatcccgccccattcgaacatccccaggttacccgggaagaccagcgtaccctgttcagatggcggggtgaaaatgccttcatagcgcatctggtggaacatcacgcggcacaccagttggtcaaacatggtggctccccacatatccgcaccgctcaaatctttcgtcggacggaagctcagttcagaaaacggttgagttggggttacgtaatcgcctttcgctgcaccttggggaaccggtttttccggtgccggaaccaccagttcgccattacgacgatcgagcacaaaaatgttgccggttttcgccggagcgtaaataactggcactttctgaccattaacggtgatgtccgccagcgtcggctgtgccggaagatccatgtcccacaggtcgtggtgaacggtctggtagctccacgccagtttcccggtagtggcattcagcgccagaatcgagctggcataacgttcctgttccggtgtgcggttaccgccccagatatccggcgtggtcacgcccatcggcagatagaccagatccagcttcgcgtcataggccgctggtgcccaggagtttggcgagttaaaggtaaaggtgtgttcgtcagacgggattgcgttcggatctttcgcgccgggatcaaaagcccacagcagctccccggtgttgacatcaaaaccacggatcacgccagacgtttcgcgggttgagaagttatcggtaactgaaccggccatcacgatggttttatcggtgataatcggtggcgaagtcggttcatacagacccggtttggtgtctggcatattgctttgcagattgagcacgcctttattggcgaaggtttcgcacagtttgccgttttcagcgttaatcgcaatcagtcgaccatcattgaccggaagaatgatacgacgcgggcaatccgccatcacttccggcgaagcggtttctgctttggcttcatgataagagacaccacggcaggttacgtgctggaaagactcgttggttttcagctcaggatcgtaatgccatttctctttgccgctggcggcatcaagcgcaaacaggcgctggtgagcggtacacaggtaaagggtgtcgcccactttaatcggcgtcacttcattggtgatttcacccggatcgttcggctgcttcacatcgccagtacggaacacccaggcttctttcagattatggacgttatcggcgttaatttgtttcagcggcgaaaagcgttgaccttcctgattacgaccataggcaggccagtcctgatcggctacgggggagatagcttcagcaggtgtggcatcggcgcttaaggtgccgttgatctcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatggtgccgagcagcagggctgcgtatagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgtcgcgagcctgtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgccaaaacctgcccgtgcgaagtgatttgtttttaaatcatatggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcatttttatttgtggttggcgtgtttcagcttgaggttggaaatcccgtgacggtaacgttgctcaagggtttcgcggttggtggcggtaacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttccgggttttcaactgcggcttgtacgccgccgcaaccgtagtggccacagataataatgtgttcaacttcgagtacatccactgcatactgaaccacggaaaggcagttcaggtcagtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtgggatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaggatgtcgtgaacgctaaacgtcagttgggactggtgccgcaggaatttaacttcaacccgtttgaaaccgtgcagcaaattgtggtgaatcaggcagggtactacggcgtggagcgcaaagaagcgtacatccgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggcgaagctgaaatcggaaacctttattctcgatctcgcaccgaaaagcccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatgatgcatctttactgggtggcgctaaaaagcatctgggcgaaagagatccatcgctttatgcgtatctgggtgcagacgctggtgccgccagtcatcaccatgaccctttactttattatcttcggtaacctgattggttcgcgtattggcgatatgcatggcttcagctatatgcagttcatcgtaccggggctgatcatgatgtcggtgatcaccaatgcctacgccaacgttgcgtcatcattttttggtgccaagttccagcgtaatattgaagagctgctggtagcgccggttccgactcacgtcattattgccggatatgtcggcggtggcgtggcgcgtggtctgtttgttggcattctggtgacggcaatttcactgttttttgtgccatttcaggtgcattcgtgggtattcgttgccttaacgctggtgctcacggcggtgttgttctcccttgcgggtttgctgaacggtgtgtttgccaaaacgttcgatgacatcagcctggtgccaacctttgtgttaacgccactcacgtatttgggcggggtcttttactcactgactttgttgccgccgttctggcaagggctgtcgcacctgaacccaatcgtttatatgatcagtggtttccgctacggcttcctcggtatcaatgatgttccgctggtcactacctttggcgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgctctgcatgaagcggactctggtgagggtgtcatcttcttaaccgatatagccggagcgccaccgtatcgcgtggcttcattattaagccacaaacactcccgttgcgaagtgatttctggtgtcacgttaccgttaattgaacagatgatggcttgccgtgaaaccatgaccagttcagagtttcgcgagcgtattgtcgaactgggtgcgccggaggtgagtagtctttggcaccaacaacaaaaaaatccgcctttcgtcctcaaacataatttgtatgagtattaacccgcgattctgatggcgcttttgctacaataaaagcgttgtttcaccctcggttattttttcatgtacaaacaagctgttattctcctgctgatgctgtttaccgcaagtgtcagtgccgcgttacctgcccgttatatgcaaaccatcgaaaatgctgcggtctgggcgcaaattggtgacaagatggtgaccgtggggaatattcgggccggacaaatcattgccgtggagcccactgccgcaagttattacgcatttaattttggctttggcaaaggttttatcgataaaggtcatctcgagccggttcaggggcgacaaaaagttgaagacggtttgggcgacctcaacaagccgctgagtaatcagaacttagttacctggaaagatacgccggtctataacgcgccgagtgcgggaagtgcgccatttggggtactggcggacaatttgcgctacccgattttgcataaactgaaagacaggttaaatcaaacctggtatcagatccgtattggcgatcgactggcctatatcagcgcactggatgcccaacccgataatggcctgtcggtgctaacctatcaccatattctgcgcgacgaagaaaacacccgttttcgccatacttcgacgaccacatcggtacgcgctttcaataaccagatggcctggctgcgtgacaggggatacgcgacactgagcatggtgcagctggaaggctacgtgaagaataagatcaatctccctgcgcgagcggtggtgattacctttgatgatggcctcaagtcggtgagccgctatgcgtatcctgtgttgaaacaatatggcatgaaggcgacggcgtttattgttacctcacgcatcaaacgtcacccgcagaagtggaacccaaaatcgctgcaatttatgagcgtttctgagcttaacgaaattcgcgatgtatttgatttccagtcacatacccattttttgcatcgggtagatggttatcgccgacccatattactgagccgtagtgagcacaatattctgtttgattttgcacgttcacgccgcgctctggcgcaatttaatccgcatgtctggtatctttcgtatccgtttggcggatttaatgacaacgccgtgaaggcagcaaacgatgccggatttcacctggcggtgacaaccatgaaaggcaaagtaaaaccgggggataatccgttgttactaaaacgactttatatcttaagaacggattcgctggagacgatgtcgcggctggtgagtaaccagccgcagggataacaatcaagcaacctgtaccggaatcgctttcgcggtacgtttcatttcattgtcgccttcaaaataggcgacgttgggtcgccaggtgcgagcttcttcatctggcatggtaacgaagctggcgatgatgacaatatcgccgacactggcgcagtgggccgccgcaccgttaacagaaataattctcgaaccgcgttctgccgcgatggcataagtggagaaacgcttgccgttggtgacattccagatatcaatggcttcgttttcgagaataccggctgcgtcaagaaaatcctggtcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgtttagtgtctactcatctgacggcatttgcgtcagcagtttgcgtaccgcgccgaagcgtgccatgtatcgcctgtaacgaattgatatttctctgaacgctgctcggtaaacaataaagaggtggctgacgatagcgcgccttgactggatactgccttcacgcaaagccacacggaagacagggaagatggatgcaccgagtaccacaccgcatgacgcggtatttaaacaatttttaatgcatgcggagacggctcgcgactttctggagatacatttgccagtggaattacgcgaactttgtgacctcaacacgcttcatttagagtcggggagtttcattgaagagagcctgaaaggacacagcacggacgtgctctattccgtgcaaatgcagggcaatcccggttatctgcatgttgtgattgaacaccaaagcaagccggataagaaaatggcctttcgcatgatgcgttattctatagccgccatgcaccggcatctggaggctgaccacgataagctgccgctggtggtgccgatactgttttatcagggcgaggccacaccttatccgctatcaatgtgctggtttgatatgttttactcgccggagctggcgcgacgcgtctataacagtcctttcccgctggtggatatcaccatcacaccggatgacgaaatcatgcaacatcggcggattgcgattctcgaactactgcaaaaacatattcgccagcgcgacttaatgttattgcttgagcaactggtcacgctgatcgacgaagggtacactagcggaagtcagttagttgccatgcaaaactatatgctgcaacgcggtcatactgaacaagcggatttgttttacggtgtgttgagagacagggaaacgggaggggagtctatgatgacgctggcgcagtggtttgaagagaaagggattgagaaggggattcagcagggaagacaggaagtaagtcaggaattcgcccagcgtcttctgagtaaaggaatgtctcgggaagacgttgcagagatggcaaatttacctcttgctgagattgataaggtaattaaccttatttaagttacctgtgttatgacagatgacgtggggtaaattaataactggcgccatcagccgtagcgccagttaagtattacgccagctcgaccattttgttgtcgatcaggcgagcatcgccaagccaggcggctaccagaattactgcccgtttgctggtttcagaaacttccagcaatgtgtcggcatcgcgaatctgaatatcatcggcgcggaagcctttttcattcagttcttgccccgcaatggtaataatttcatcgagatcccgttccccagcctgcaatttgtcagcaatcgaacttaaaactttgtacagaccaggcgcaattttgcgttgttccgccgtcagataaccgttacgggaacttagcgccagaccgtctttggcgcgcataattggcacaccgacaatctcaatatcgaagcccatatcggcaaccattttgcggatcagcgccagttgctgaaaatctttttcaccgaagcaggcgatgtccggctggaccaggttgaacagcttgctgacaatagtcgaaacgccgcgaaaatgtcccggacggctggcaccttccagcatggtcgaaaggccaggaacgtcaacgtaagtgtgggtttcagtaccgttcgggtagatctcttttaccgaaggggcgaaaactaaatccactttacgtttgtttagcttctcgcagtcctcctgcaaggtccgtggataacgagccagatcttccgggcggtcgaactgcatcgggttaacgaaaatactgacgacgaccacatcggcgcgggctttggcttcgtcgaccagcttcatatggccatcgtgcaggttacccatggtaggcaccagcgccacgcgcttgccttccatacgcaggcggcgaatttgctgacgcagcagcggcagggtttcgataattaacacaacgtgactccttaatggaaactgtgttcttcgcccggataaacgccggactccacttcagccatatactgccgcacagccgcgcggatgtcgcccgtttcggcgaggaaatttttagcgaatttaggaatgtgaccgccggtaataccaaaggcgtcgtgcatcacgaggatctgcccgtcagtgacgttgcctgcgccaatgccaataaccgggatcgccagtgcttcggtaatacgttttgccagttcaaccggcacgcattccagcaccagcagctgtgccccagcagcttctaaggctaatgcatcgctgagcagttgatcgcccgcttcatcgccgcgcccctgaactttgtagccaccgaaaatattcactgactgtggtgttaaacctaagtgaccacatacaggaacggcacgttcggtcagcatttgtacggtttctaccagccactcaccgccttcaattttgaccatgttagcaccggcacgcataaccgttgcggcgttttcgaaggcttgttccggcgtggcatacgccataaacggcaggtcagccagcagcaggcagtttggtgcgccgcgacgtacggcggcagtgtggtaggcgatatcggcaacggtaactggcagggtggagtcgtgcccctgaaccgtcatgcccagcgaatcgcccaccagcatgacgttaagcccttcatcagcaaagagtttggcgaagctatagtcataagcggtgatggtcgcgaaacgttttttttcctgtttgtacttctgcagtaaggagatggtggtcggtttcataacgtatcctgataaattgatgttgtgctgtctggcattttatcagtcacattggtgggggcaatgatttatccgtagcagcactgccagaaggtgacagtgctgctacgttatcagggataggttacctggaaagtactggtggctttaaattcgccgggttcgatagcaatattcccgtcttgctttaatgttgcctggaaatgaagaggctgtgatgtgccgttaccttgattagggtaaaccccatcggaggtgtcatcttcggtttcataatctatataaacagaattcgtatcattaggttttaatgtcattagcggatttttactggttgctaaaccttcaatgagtacgccaacgcctttggcggcagtgcttccagtaagcgtattaccaagcagttgtgtgttttgagtacctacttttccagtgacgagttttgtttcaatattacgcacacgaatacaattctgaagcgagatatcaaagggaacaggtgaagcgccatttttaattgtcccagagctatattctcccattctaaccgttgaaccattgactgatggcccggtaagtatggaggtaaaacatgttggtaaggttaatttgacattattcagtgtgaaattgacataaatgtggttgctgtgatctacaacttttgtaccaggactgtaggccttaaacgaataaaggtaatttgatgaactggataactggacttgctgattaagtgtaggatcgaaattagtatctgtataaaattcaacagttatgttgtgtactataccaccaatagcccaaaacttatcgtagtcgtctgctttgttgcaacccttagtttgtagatcgctgtctgtgacggaaaagaaaaattcttggttggaaggatctccgatatagattcctggcgattgaatgtcagttattgtatcgtatgcagaccagacccttgatattaacatggtgtaatacagaccaggaacagatgtattaaatagtttatgtccgccataatctttacctgaatagaccatggcattttcaatagttattggaccaggattcgctctgccagatgtattgcagtaaagaataccaccaccggtacctgtatccaggtatgaccagtacatttttaccccagtcgggccgagctgcgtgggtttataaaaaaccaagttgcttgctgttgatgtgtaattaaaggtcatctgtgcggcagtggaggggcctcgatagttatcaactcctgcattatttcccacaataaaacttgtatatgcactgactgtattacaacaagaatacagtgctaaaaaaagaatgtacctgaagatagtcttcatttttactccaatgtttctttattgttatggtttgcgctgtttttgtttgttattcgtagtaaatatccactaacacatggctcataagttgaccagatgtaacactcaatgcaggatcgattttttgcattcgggtgctaaatttccaggatgaaccattcatgtcatccgacattactggataaacggaacgagatccgcctgaagcattaagaacattgaatgtattcgccgaatcctgagtagaaaatataactactcctacattacttgctcctgacgaaatttcattagcaaatatttgcctagagccagcagccatgacaccgctaagggctctaaaatcaatatgtaactgatttagcacatcgccagttccctgtaatgcacagtcggatacagtgatagtgaactcttttccacctggttgataactttcaggagtaacattacctgaaaaatatcccaccccaacgacgccaagatcaatattaccctggttactgattccgcttttgcaggtgctgttttttacattggcaacaaggtcaatatcctgtccagcaatggctggacaggcgatgcaaaacagtaatgacagaaacagaattattctcttcatcagcttacgttgagtgggatgcatatatagttcctgaatctgtaagtctgttagttataggttactgtaaatgtggctggtgcagaaaacttacccgcagtgacattgtttacggttttatttttttccacgaccaggcgtgcactcatcggataataaacgaccgcattggctgcagtggagattgttacctcttgtgatgctggtgttacacagctaaattgtgttgcactccctgttgccggagttacagtgctccagacttcaacggcgacagcacttgctttatctgcggctgtggaaccatttgcaaaccccgcaccgtcattagcagttccctcgcatgtggctcgcttggttaattttatttgcgcttttttattggggatacccgcacagtctttgaatttgagtttgaatgtttttactttggtcttggcattgatttcagaaatatatacatcaccaaaatcaacaacagaaatgtcctgatcagagtcatttactaatgtagcggtacaagtacccatttctacagtagtaataacggtcagtccaatactgtctgttgccgcataagagagtacgctgaacaatgaggcagccaaaacgacactgctggataatccataacgtaaatttttaaatgtcatcataattatccttcttattgatagatgaaattaaacgtcgccagtgcacgaaaattccccggtacgccttgccctgcatctgtttcacgtagcgcaacggtcatttcaagacccttatcgggctgcatctcgtctgtgctccagcgtatcttttccgcactgttaggtttaaggaaagtggcatcatcagtagtccgttttttgaaacccataccgatattacttgtcgtcgaagatgaatcaccagactgcggtataataagcttaggtgagcttgatgatgcatttccggtcagagtggtatcaatccaactgatgccactgctgcacccactggcaaccagtttaaaatcagcctgagattctgtcgttttattcgcgatcttatccagacccatcttagggattctcaatgtgtagttattattgccatcattcgtgacgttattaccagtaagtgtgatgttacaggttgtcgctttgacagtggctgtaaactctacattaatatccgttgcaaatactgagggtgataataatattcccatcagtatcactattttatgtggcgttgtttttatcatttgacgtcccttgtagttactgaatctgacaccgaattccattcagaataatagattgtgctattttttctgcttctgggctttgttgataatgcgcaagacaacttacgggtttactttgttcgagccatttaatgctgatatttccctgctgctcaataccacgaacaaatgcttgtccaccctgtccaacattaccaatgacattgccttgctcatcataaatatctgcagcaaatggaatatttttaccatcacttcgtgtgatgttcataatggctgattgcccttgcacggtttcaaaatcagcaaagacgactgaaccctgacgcggtacagctactgcactggtactttttaattcaacatcgttctcaagatcgttgatatccagcgcgatacggttttcatgataaggagaaagagcgctggtgacaccataaccccatcgatcgatagtactgttgccataatttattcgcgctccttgagcacctggagcctgaactaccgccagtgtatcggagtcgctaaaactatcattactgaaagtcagtccaccgctatgcaatacaaaaccaccgtcggtgctgagagaaacttgacggctgttatcgctatttgcagaaattgaacctgccagcgttccccatggtgactcatagctggcataacccccaacataactcaaatctttgctggctttattcatcgtatagccagtattcacgctataactgacgcgagcgttatcgctatagccactgctgctaacgttgagttggttattacccttaaagtcactgcttatttgagtatcaatactctggaaacctgaagtacgttgttcagtgccaagtaatttttcaattggaatggtgaaactaagataaacgctatcgtcagtgtcgccgtcttcattccatgaacgctgggcactgacactgtagctgccccaggatgtactgttactgtagccaatagagtaattgctacgattttgtccggaagcccagtaatcggaccaacttccggaaagataaaatgaaccgtaatcttttttctcaaatttcaacggttggttaatactgaccgtaacctgatttttcatgcgtgagtaattacgcatggatttcggttcaagatcttgttcgggatgtttcacttcatcaattagagttagtgcatcattaagaccaaggtaattctgtgtcgaatagcgataggccgcgatattcagtgaagtacttgtttcttcgaataacttgttccaggaaacacgataactttgcccctggtatgttttatcatccgggatacgaacattggaatgagtcacatcgaaagaaaatgcaccaactgaagtattcagaccaagacctaacaaaccagcggtatagttattatcggttatctgaataccggtataacccgtcagatagttattcaggccgtagtagtagcttgcttgaaataaattaggctcatcctgaatatcatcttttaagacctgaccgccgctaatatcccaacgtccaacgccagggcgtaacatttgaacaacggatgagaaaggttgcgagaatgtccgctttgagccatcggattcttcgatggtaacaataagatcgctgccgtaccctgacggactcagatcatcaatgacgaaagcgcctggcggcaccgtcgtttcataaatcttatagccaccttgcgtaatagtgactttggcgttggtattggcaacgccatgaatgataggcgcaaagctggctaaagtcggaggcaacatgcggctgtcactgtataaacgaatgcctcggatactgacggaatcaaaggtttcgcccgtcgtataagactcaccaagaatgagttgagaacgcagcgaggcgatatcacgctgaacataccgattcttaaaatcataattactgccagaatcggtcatccagttgtagttgcccgaggcacgcagtcgccatgcacctaaattcatcccaccgttaaatgcagcataaatgctttcattttttcgaccaggggtttcactatgatatccgttgaggttgtatgacaacatggccgcattaatgccgttttcccataacgatggatcaacatagttttggtaatttttcattacccaggcttgaggaacgtctatatccagacgttgatcgttaacgtcataacgaacagaagcctgagggataatttccgtcaaattgaggcaattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgtaccggctgagatcaatattagatgcattctgccccatcaggaaggtatggtcatattcaacgagttcagcactgaaagcagtattgcaatacagcagcgcgcaaaacgtggcgatacgggtcagatgatgataatttttagtatattctatagtcacgctatgcttcctgcggaattatatccttgcctgattacagcctggcattaccttcaattgcgccaccaaagtcattaatggcgtaaaaatgcacttttgcagaattcgctttgccattaaggccattgactttcatgacctcatcactaaatggtgcaatcattttcacatcaatcggatagcgtttaccgctagcttctaaatcaccactgctaaaagagacgtagtaaggggttggattggtcactcgtaatgacgccttaccttctgaacctgaccagaaccacttcagggctaacggggcttcagagggatttcccttcaatccatccgggcgatagaaaagttttatacgtgtgcgaaatgccagttgcagcaggctttgattcgcgaccttttctgcatctggttttggtggaacttccagtacgttaaaccagaacacgctctctctgtctttaggcagtgaggtgctggctgtgtacattaatttgattgtttgcccacgtttggcatcaatacgcgatactggcggcgtagcagtaaaagggactgtaatactgccaggctcagcgttgtcatcgccagtatctaaccaactctggacaagcaacgggttattccctttattttccagacgtacgttgacacttttttgatcgcttttatatattacgcgagtacccgaaatgacaatgtccgcaatagacgatgaactaaaagccatacaggttacgaagcataaagctgttgtatgtttggtgttaaaaaacataaaccatccctgatagagttaattaaaacagggaataatataaaatagaaattattattccctgtatattcattcaatcaatttaactggtgaatacttactgataagtaatggtgtatgcagtgttagtttttacataaccagcagttgctgtttggtctgcgacggcacgaacgtaagacgctttaaaatcataaacagcagattttgtcgttgcatccagggctttagtatacacatcgccagggttgttaatttgaacctgtttgatagtggaaccatcaatattgtgtagagcgatattaacgccgtcagatgggttgttaatagacatgtcgttgttcaaagtccctttgctgttaccaaagaaaacagaaccgaaggtcattttagccgtgctacctggattcggatttgctttgctgcagtcaacggtgatgctgaaaggtttagctttagcgccaacggtgtcattcagtacgccagcatcgatttcaccaacggttgcggtttgcagcaggatcagaccatccttgttaccgccgtcaacgcgggtttcacaggtgttatcaacaaccagaccactgatatttaactgaccgccgtccatatcagcagaagcagtacctgcaaccatcgccagcataagaccagacagggcaaaacctaattttttagacataaaaatcctttaataaaattccattagtcagactacatgtttgaagaatgactattcatgacacaaataggagaaacaaatgttagatattaatgagcaatgatatttgttacccaaatttacaaccattgttcattaggtcgcctattgtgcactttagaagcttttgaacaaattaaatttacttaattcaaaattaagtaaaaataagttcacaagtgcaattggttagggtatggagatgggattgatatttatttataggaagttatattatttccgcaaagagatgtttaaactaaaatcgtaattaaggaaagagatgagatatgattttcagaaaatatttatattcgcaatataaataaattaccatttgtttaatttgtcaaatgctcttgtatgtaagatttgacgcaacatctccccatcaggaaacaccaactccggcgcgatttcaaacagcggccacagcataaatccacgattcttcatatcgtagtgcggaacggtcaggcgttcagtatttatcacttcattaccaaacagcatgatgtcgagatccagcgtgcgtggtccccagcgttcagctttgcggacgcgaccttgctgcaattcaatacgctgtgtgtgattgagtagctcttcaggtgcaagagaggtttccagcgccacggctgcgtttaagtaatcgggttgatcttgcggccccagcggtggggtgcggtaaaacgaagaaacggtaagaatgtggctttcagggatatcgcctaatgctttcagggcagcattgacctgctccagcggagaggccagattgctgcctatggcaatatacgccactgtcatgcggtaccctcacgacgtggtgcgcgtttgcgtggacgacgagtacgacgacgcggtgacggttcttcatccagctcgttgagcatccctttttggtctggtggcgcggaaacctggaactcaccccaccatttcaccagacgctgcagttcagcgttacgctcaacttcagctcgcaaggccaacaggtcataagccgcacggaacttaggatgctccagcagtttccatgcgcgtttaccctgacgacgggacatacgcaactgcaactgccagatatcgcgggttaatgtcgtcagacgtttcgggattgccagtgaacggcaggcttcgtccagcacgtcgttcatcgccagcgcgaaagcgtcgtgataggtcaggccgctttcctgggcgatcttctgtgccgtctccagcagtgggtaccagaacatggcggcaaacaggaacgccgggttcacgcgcatatcgttatggatacgcgtatcggtattcttcagcacctgttcaatgatccgctccatcgggctgtcgccattttccgtgaagtagcgggtaatggtcgggaacagcggctggaacagatgatattcacacaacagcttataggtttcgtaaccgtagcccgcttgtagcagtttaagcgattcttcaaacaggcgtgccggtgggatatcgttcagcagggtagcgaggcgagggatcggttctgcggtttccgggctgatgcgcatacccaatttggcggcaaaacgtaccgcgcgcagcatacgtaccggatcttcacggtagcgcgtttccgggttaccaatcagacggataacgccgtccttcagatccttcatgccgccaacgtaatcacggacggtaaaatccgctacgctgtaatacaggctgttgatagtgaaatcgcggcgctgggcgtcttcttcgatggagccgaaaatgttgtcgcgcagcaacatgccgttttgcccgcgttgggaggtcgtgcggtcgctgacgttaccttcgtggtgtccacggaaggtcgcaacttcgataatctccgggccaaacattacatgagccagacggaaacggcgacccaccaggcggcagttacggaacagtttgcgcacctgctcaggcgtggcgttagtggttacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcgggcacggcggtaagccgccagtttttgacggctgactgaaggatttgctcgacgctgaaatcctgccagtgtgcttctgcctgctgccccagaaattgaagtgccgcgattagtaccgggcgtggatcgcctttcggcaacgcaggcgcatgattctgcttggaaagtttagcgccttgtggattaagcgccagcggcagatgaatgtaatctggcactttccagccaaaaagctggtacagcgagatttgccttactgttggttcaatcagatcagccccacgcactatttctgtaacgccctggaaatgatcatcaaccacaacagccaggttgtaggcgaacaacccatcacggcgatgaatgataaaatcttcccgtgccagtttttcgtcggcgtgaataatgccgcgcagctggtcagtaaattgcgtgaccggatgctgctggcggatacgcactgcggcgttgtctggtccatgatgcaacacccggcaatgaccgtcgtaaataccgccaatgctttgaatacgcgcacgcgtacaggtgcagtaataacttagtccttgttcatgtaaccaggcgagtgcttcacgataggcgtcgtgacgttgcgattgccagagaacatcgccgtcccagtgcagaccgtaatgttccagctggcgcaggatagtttctgcggcaccgggaacttcacgaggcgggtcgatatcttctatgcgtaccagccagcgaccttgccgggcgcgagcctgcaaatagctgccgagcgcggcgatcagagagccaaaatgaagctcgccggaaggagagggggcgaagcggccaatatactgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactttactacaatgtaaccggcagtgattttttaagagccatgccttcagcagaaatttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttctgcgccgtattttacttcgcttttcagcgagctatagcctgacagttctgaaattgattcattaaggatagcctctttcgtcaacctgttagcccaaagcgtgttgacgcaaataaatgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgcatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgacgcatccctaaccacaccacacgcgaacgcagccattgtccggcgtcatcaagcgtgagtgtgaaaccaggttgacgaatccgtccggctaaaagagaaagcgccttctctttctcggcgctcacttcgcctaaaaatgccagagtcagatgcaaattatcggcggcgaccggacgtcccgcctcaggtgggaagtgtgtggcgcgccaatggataatctgttcgcggatttctgcaggtaagtcgatagcaaagaacagacgttgcggttcagacatgtgaggcactcggttatgaattaccgcgatgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaaggttggttttctccctctccctgtgggagagggccggggtgagggcatcagcgcgcacgttcaccctcaccctaaccctctccctcaagggagaggggaccgatcgagcacaaattttgagagatatcttcttctgtcttgtaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctactgctaaaactggctatcgtttttgccgtgctgatcgccatttacggcgtttatctcgatcaaaaaattcgtagccgtattgatggcaaggtctggcaactgcctgcggcagtttatggccgaatggtcaatcttgagccagacatgaccatcagcaagaacgagatggtgaagctgctggaggcgacccagtatcgtcaggtgtcgaaaatgacccgtcctggcgaatttaccgtgcaggccaacagcattgagatgattcgccgtccgtttgatttcccggacagtaaagaaggacaggtgcgcgcgcgtctgacctttgatggcgatcatctggcgacgatcgtcaatatggagaacaaccgtcagttcggtttcttccgtcttgatccgcgtctgatcaccatgatctcttcgccaaacggtgagcagcgtctgtttgtgccgcgcagtggtttcccggatttgctggtggatactttgctggcgacagaagaccgtcatttttacgagcatgatggaatcagtctctactcaatcggacgtgcggtgctggcaaacctgaccgccggacgcacggtacagggtgcgagtacgctgacgcaacagctggtgaaaaacctgttcctctccagcgagcgttcttactggcgtaaagcgaacgaagcttacatggcgctgatcatggacgcgcgttacagcaaagaccgtattcttgagctgtatatgaacgaggtgtatctcggtcagagcggcgacaacgaaatccgcggcttcccgctggcaagcttgtattactttggtcgcccggtagaagagctaagcctcgaccagcaggcgctgttagtcggtatggtgaaaggggcgtccatctacaacccgtggcgtaacccaaaactggcgctggagcgacgtaatctggtgctgcgtctgctgcaacagcaacagattattgatcaagaactctatgacatgttgagtgcccgtccgctgggggttcagccgcgcggtggggtgatctctcctcagccagcctttatgcaactggtgcgtcaggagctgcaggcaaaactgggcgataaggtaaaagatctctccggcgtgaagatcttcactacctttgactcggtggcccaggacgcggcagaaaaagccgccgtggaaggcattccggcactgaagaaacagcgtaagttgagcgatcttgaaactgcgattgtggtcgtcgaccgctttagtggtgaagttcgtgcgatggtcggaggttctgagccgcagtttgcgggctacaaccgtgcgatgcaggcgcgtcgttcgattggttcccttgcaaaaccagcgacttatctgacggccttaagccagccgaaaatctatcgtctgaatacgtggattgcggatgcgccaattgcgctgcgtcagccgaatggccaggtctggtcaccgcagaatgatgaccgtcgttatagcgaaagcggcagagtgatgctggtggatgcgttgacccgttcgatgaacgtgccgacggtaaatctggggatggcgctggggctgcctgcggttacggagacctggattaaactgggcgtaccgaaagatcagttgcatccggttccggcaatgctgctgggggcgttgaacttaacgccaatcgaagtggcgcaggcattccagaccatcgccagcggtggtaaccgtgcaccgctttctgcgctgcgttcggtaatcgcggaagatggcaaagtgctgtatcagagcttcccgcaggcggaacgcgctgttccggcgcaggcggcgtatctgacactatggaccatgcagcaggtggtacaacgcggtacgggtcgtcagcttggggcgaaatacccgaacctgcatctggcagggaaaacagggactaccaacaataacgtagatacctggtttgcgggcattgacggcagcacggtgaccatcacctgggtcggccgtgataacaaccagccgaccaaactgtatggtgccagcggggcaatgtcgatttatcagcgttatctggctaaccagacgccaacgccgctgaatcttgttccgccagaagatattgcagatatgggcgtggactacgacggcaactttgtttgcagcggtggcatgcgtatcttgccggtctggaccagcgatccgcaatcgctgtgccagcagagcgagatgcagcagcagccgtcaggcaatccgtttgatcagtcttctcagccgcagcaacagccgcaacagcaacctgctcagcaagagcagaaagacagcgacggtgtagccggttggatcaaggatatgtttggtagtaattaacatctaagcgtgaaataccggatggcgagttgccatccggtaaaataacatcccatctaagatattaaccctttcttttcatctggttgtttattaacccttcaggaacgctcagattgcgtaccgcttgcgaacccgccagcgtttcgaatattatcttatctttataataatcattctcgtttacgttatcattcactttacatcagagatataccaatggcgcgttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggcctgctgcaactattgcggcgcgacagtctgctaccggcactaaaaccgatacgccgattcaaaaagtgccacagtctatttctgttgtgaccgccgaagagatggcgctgcatcagccgaagtcggtaaaagaagcgcttagctacacgccgggtgtctctgttggtacgcgtggcgcatccaacacctatgaccacctgatcattcgcggctttgcggcagaaggccaaagccagaataactatctgaatggcctgaagttgcagggcaacttctataacgatgcggtcattgacccgtatatgctggaacgcgctgaaattatgcgtggcccggtttccgtgctttacggtaaaagcagtcctggcggcctgttgaatatggtcagcaagcgtccgaccaccgaaccgctgaaagaagttcagtttaaagccggtactgacagcctgttccagactggttttgactttagcgattcgttggatgatgacggtgtttactcttatcgcctgaccggtcttgcgcgttctgccaatgcccagcagaaagggtcagaagagcagcgttatgctattgcaccggcgttcacctggcgtccggatgataaaaccaattttaccttcctttcttacttccagaacgagccggaaaccggttattacggctggttgccgaaagagggaaccgttgagccgctgccgaacggtaagcgtctgccgacagactttaatgaaggggcgaagaacaacacctattctcgtaatgagaagatggtcggctacagcttcgatcacgaatttaacgacacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacaccctgctgaccggtgtcgactttatgcgtatgcgtaatgacatcaacgcctggtttggttacgacgactctgtgccactgctcaatctgtacaatccggtgaataccgatttcgacttcaatgccaaagatccggcaaactccggcccttaccgcattctgaataaacagaaacaaacgggcgtttatgttcaggatcaggcgcagtgggataaagtgctggtcaccctaggcggtcgttatgactgggcagatcaagaatctcttaaccgcgttgccgggacgaccgataaacgtgatgacaaacagtttacctggcgtggtggtgttaactacctgtttgataatggtgtaacaccttacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatctcactaaaaccaacaacctgatggcggaccctgagggttccttcttctcggttgaaggtggcgagatccgcgcacgtggcgtagaaatcgaagcgaaagcggcgctgtcggcgagtgttaacgtagtcggttcttatacttacaccgatgcggaatacaccaccgatactacctataaaggcaatacgcctgcacaggtgccaaaacacatggcttcgttgtgggctgactacaccttctttgacggtccgctttcaggtctgacgctgggcaccggtggtcgttatactggctccagttatggtgatccggctaactcctttaaagtgggaagttatacggtcgtggatgcgttagtacgttatgatctggcgcgagtcggcatggctggctccaacgtggcgctgcatgttaacaacctgttcgatcgtgaatacgtcgccagctgctttaacacttatggctgcttctggggcgcagaacgtcaggtcgttgcaaccgcaaccttccgtttctaatttctcttttggggcacggatttccgtgcccatttcacaagttggctgttatgcaggaatacacgaatcattccgataccacttttgcactgcgtaatatctcctttcgtgtgcccgggcgcacgcttttgcatccgctgtcgttaacctttcctgccgggaaagtgaccggtctgattggtcacaacggttctggtaaatccactctgctcaaaatgcttggccgtcatcagccgccgtcggaaggggagattcttcttgatgcccaaccgctggaaagctggagcagcaaagcgtttgcccgcaaagtggcttatttgccgcagcagcttcctccggcagaagggatgaccgtgcgtgaactggtggcgattggtcgttacccgtggcatggcgcgctggggcgctttggggcggcagatcgcgaaaaagtcgaggaagctatctcgctggttggcttaaaaccgctggcgcatcggctggtcgatagtctctctggcggcgaacgtcagcgggcgtggatcgccatgctggtggcgcaggatagccgttgtctgttgctcgacgaaccgacctcggcgctggatatcgcccaccaggttgatgtgctgtcgctggtgcaccgtttaagtcaggagcgtggcctgacggtcattgccgtgttgcacgatatcaatatggcggcacgctactgtgattatctggtcgccctgcgcggcggtgaaatgattgctcagggaacgcctgcggaaattatgcgcggcgaaaccctcgaaatgatttatggcatcccgatgggtattttgccgcatccggcgggtgctgcacctgtgagttttgtttattgatgagcggcttacctcttatttcgcgccgtcgactgttaacggcgatggcgctttctccgttgttatggcagatgaataccgcccacgcggcggctattgatcccaatcgtattgtggcgctggagtggttgccggtggaattactgctggcgctcggcatcgtgccttacggcgtggcggataccatcaactatcgcctgtgggtcagcgaaccaccattgccggactcagtgatcgacgtcggtttgcgcacagaacctaaccttgaactgctgaccgaaatgaaaccatcgtttatggtctggtcggcaggatatggcccttcaccagaaatgctggctcgtattgcgccgggtcgcggatttaacttcagtgacggcaaacagccgttggcgatggcgcgtaaatcgctgacggaaatggcagatttacttaacctgcaaagcgcagcggaaacgcatttagcgcaatatgaagactttatccgcagcatgaaaccccgctttgtgaagcgtggtgcgcgtccgttattgctgacgacgcttatcgatccgcgccatatgctggtcttcggtccaaacagcttgttccaggaaattcttgatgagtacggcatcccaaatgcctggcaaggggaaaccaacttctggggcagtaccgccgtcagtatcgatcgtctggcggcgtataaagacgttgatgtgctctgttttgatcacgacaacagcaaagacatggatgcgctaatggcaacgccgctgtggcaggccatgccgtttgtccgcgccggacgctttcagcgcgtacctgcagtctggttttatggtgcgacgctctcggcaatgcactttgtgcgcgttctggataacgccatcggaggtaaagcgtgagtaaacgaattgcgcttttcccggcgttattgctggcgctgttagtgattgtcgctacggcgctcacctggatgaacttctcgcaggcgctgccgcgtagccagtgggcgcaggctgcctggtcgccggatattgacgtcatcgagcagatgatttttcactacagcttgttgccgcgtctggcgatttcgctgctggtgggcgcgggtctggggctggtgggcgtgctgtttcagcaagtgctgcgtaacccgctggcggagccgacgacgcttggcgttgctacaggcgcgcaactggggattaccgtcactacgctctgggcgatccctggtgcgatggcgagccagtttgctgcgcaggcaggggcttgtgttgttggcttaattgtctttggcgtcgcgtgggggaaacggctgtcgccggtaacgctgattctcgcggggttggtagtgagcctttattgcggcgcaatcaatcagttactggttatcttccatcatgaccaactgcaaagcatgtttctgtggagcactggaacgctgacgcaaaccgactggggcggcgttgagcgtttatggccgcagctgctgggcggtgtgatgctgacgttgctgctacttcgtccgttaaccctgatggggcttgatgatggcgtggcgcgcaatctcgggctggccttgtcgcttgcgcgtctggcagcgctgtcgctggcgattgtcatcagtgcgctgctggtgaacgctgtggggattatcggctttatcgggttgttcgcgccgctgctggcaaaaatgctgggggcgcggcgtctgctgccacgactgatgctggcgtcgttgattggtgcgctgatcctctggctttccgatcaaatcatcctctggctgactcgcgtgtggatggaagtgtccaccggttcggtcactgcgttgatcggtgcgccgctgctactgtggctgttgccgcgtttacgcagcattagcgcgccggatatgaaggtcaacgatcgtgtcgcggctgaacgccaacatgtgctggcgtttgccctcgcgggcggcgtgctgctgttgatggctgtggtggtggcgctgtcgtttggtcgtgatgcgcacggctggacgtgggcgagcggggcgttgctcgaggatttaatgccctggcgctggccgcgaattatggcggcgctgtttgcgggcgtcatgctggcggtggcgggctgtattattcagcgactgaccggaaacccgatggcaagcccggaagtgctggggattagctccggcgcggcgtttggcgtggtgttgatgctgtttctggtgccgggtaatgcctttggctggctgttacctgcaggcagtctcggcgcggcggtgacgctgttgatcattatgatcgccgccggccgcggtggattttccccacaccgtatgttactggcggggatggcgttaagcaccgcgttcaccatgcttttgatgatgttgcaggcaagtggtgacccgcgaatggcgcaagtgctgacctggatttccggttcgacctacaacgcgaccgatgcgcaggtctggcgcaccggaattgtgatggtgattttgctggcgattaccccgctgtgccgccgctggctgaccattttaccgctgggtggtgataccgcccgagccgtaggaatggcgctgacgccgacgcgaattgcgctgctgctgttagcggcttgcctgacggcgaccgcgacgatgactattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatcccggcggggctgctgtcaacctttatcggcgcgccatattttatctatttgttgagaaagcagagccgttaatttttccatataacggccctgtacgcctggacggataaagcgtttacgcgacaacggatgcccgatgcgacgctggcgcgtcttatcgggcctacaaacggccccgaatcgtaggtcggataaggcgttcacgccgcatccgacaaaccatgctggatcacaacttcgcaaacacccgacgtgcagcatcgatggtgttattgatatcttccatgctgtgcgccacggacataaagcccgcttcaaacgctgacggtgccaggtaaacaccttcgtccagcatcatatggaagaaacgcttaaagcgttccacgtcacaggccatcacatcctgatagcacgtcacggactcggcgtcggtaaagaaaataccgaacatgccgccaacgtggttaacgaccagcggaattccggcttcttctgccgcttccagcagaccttctgccagacgtgttgtcagctcatccagcgtttcgtgaacgcccggctgcgcgacttcattcagacaggcgaaacccgctgccatcgcaatcgggttaccggaaagcgtacccgcctgatagaccggacccgtcggggccagcgcatccattacatcacgacgaccaccgaatgcgcctaccggcattccaccgccgatgattttgccgaggcaggttaaatctggcactacgccgtaataatcctgtgcgccagctagcgctacgcggaaaccggtcatcacttcatcgatgatcagcaacgcgccaaattcgtcgcacagcgcgcgcagacctggcaggaactctggcagcggcggaacacagttcatattgcctgccaccggctcgacgataatacaggcaatctcttgcgggtattgctcaaatgcggcgcgtacagaagccagatcattataagtacaggttaaggtatatttggcgaaatctgccggaacgcccggcgagtttggctggcctaacgtgagtgcgccagaaccggctttcaccagcaggcagtcagcgtgaccatggtaacacccttcaaatttaataattttgtcgcgaccggtaaaaccacgggccaggcggatggcgctcatggtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggattgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgttgggctggcagcggttgcttttgacaaaggtgtcgcctggttgcagaaccaacgtatgggggcgctggtacatactgctgataattatccgcttctgttaaccgtcgcttttctctgttcggcggtgctggcgatgtttggctactttttggtgcgcaaatacgcgccggaagcaggtggttcggggatcccggaaattgaaggggcgctggaagatcaacgtcccgttcgctggtggcgtgtattgccggtgaagttctttggcgggctggggacactcggcggaggcatggtgttggggcgcgaagggccaaccgtgcagatcggcggtaacattggccgtatggtgcttgatattttccgcctgaaaggtgacgaagctcgccatacgctgctggcaaccggtgctgctgcggggctggctgcggcctttaacgcgccgctggcgggtattttgtttattatcgaagagatgcgtccgcagtttcgctatacgttaatttcgattaaagcggtatttattggtgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggcggcaatattaccaaatgggtgctaatgggcggtgcgattggcggtctgtgtggattgctggggtttgtggcaccagcaacgtcgggcggcggttttaacctgattcctatcgctaccgcggggaatttcagcatgggaatgctggtgtttatcttcgtcgcgcgggtcattaccaccttactctgcttctcttccggcgcgccgggcggtatttttgccccgatgctggcgctgggtactgtgctgggaaccgctttcggaatggttgccgttgagctgtttccgcaatatcaccttgaggcggggacgtttgctattgccggaatgggggcattactggcggcatctattcgcgcgccgttaacggggatcattctggttctggagatgaccgataactaccagctcattttgccaatgattattaccggtcttggcgcaacactattagcgcaatttaccggcgggaaaccgctatactcggcgattcttgcgcgcacgctggcaaaacaggaagctgagcaactggcgcgaagcaaggccgcatcagccagcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgattataccgaaggtctggaaggttctcgtttcatcgtgaccaacccgaacgcgaaaagcacctgcggttgcggttcttcctttagtatctaatctgttgttcatgtgccggataaactatccggcacatcttctctcttcaacgcccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagaacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgtcccgccgcctactgcggttaccacgcccagtaccagaacaccaaaagggtccatacgcaattttccggctaacaaaacgccggagatggcaaataccgctgtgccgactatatccagccaatagacgagcattgttcaatccccactgagcacctgaaaaggtcaggcgctaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgctcaatcttttgcgcttgtggaggatagtcggaatagctgctgaccccaaccggcgtgatcccggcggcaaaggcaagttcagtgttggcgggagaaagcgtgatgacgcgcggcgcggcgttgagccacagtggcgcaagaaaagacagggcgaccagcgccctgaacagtgacttagccatgtgcaagtttctgcaccagtgactcaaccatcaggctggactgtttagcggcaacagccaggaactcatcgaagctaagatgagactgttgatcggccacgtcggagatggcgcgtacgacaacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttaaagcctgccggacagcctggtaactgaccgtattcataaccaaatgccgtgacatccgcgtcgtgataacgtgcttcgtccgagacaacgatatcgcccactttcaacgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgccgagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagatcctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgccaaagaaattttaagccgtctgaaagagcttaaattactggaagcatacggcctggatgaactgaccggtccctttgaaagcattgttgagatgtcatgcctgatgcacgatatcggcaatccgccgtttggtcattttggcgaagcggcgataaatgactggtttcgccaacgtttgcacccggaagatgccgaaagccagcctctgactgacgatcgctgcagcgtggcggcactacgtttacgggacggggaagaaccgcttaacgagctgcggcgcaagattcgtcaggacttatgtcattttgaggggaatgcacaaggcattcgcctggtgcatacattgatgcggatgaatctcacctgggcacaggttggcggtattttaaaatatacccgtccggcgtggtggcgtggcgaaacgcctgagacacatcactatttaatgaaaaagccgggttattatctttctgaagaagcctatattgcccggttgcgtaaagaacttaatttggcgctttacagtcgttttccattaacgtggattatggaagctgccgacgacatctcctattgtgtggcagaccttgaagatgcggtagagaaaagaatatttaccgttgagcagctttatcatcatttgcacgaagcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctacgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcggcttgaattgcagggctatcgggtcattagcggattattagagatttatcgtcctttattaagcctgtcgttatcagactttactgaactggtagaaaaagaacgggtgaaacgtttccctattgaatcgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcaggctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttctccgttccagagctctccgttctgccagggtggccagggcggtaatggtggcggccagcaacagaaattcatggcgctgggttccggcgtcatcattgatgccgataaaggctatgtcgtcaccaacaaccacgttgttgataacgcgacggtcattaaagttcaactgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgaaaaacctgacctcgcagatggtggaatacggccaggtgaaacgcggtgagctgggtattatggggactgagctgaactccgaactggcgaaagcgatgaaagttgacgcccagcgcggtgctttcgtaagccaggttctgcctaattcctccgctgcaaaagcgggcattaaagcgggtgatgtgatcacctcactgaacggtaagccgatcagcagctttgccgcactgcgtgctcaggtgggtactatgccggtaggcagcaaactgaccctgggcttactgcgcgacggtaagcaggttaacgtgaacctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactcaacattcagcgcggcgacagcaccatctacctgttaatgcagtaatctccctcaaccccttcctgaaaacgggaaggggttctccttacaatctgtgaacttcaccacaactccatacatcttcatcatcctttaggcatttgcacaatgccgtacgttacgtacttccttatgctaagccgtgcataacggaggacttatggctggctggcatcttgataccaaaatggcgcaggatatcgtggcacgtaccatgcgcatcatcgataccaatatcaacgtaatggatgcccgtgggcgaattatcggcagcggcgatcgtgagcgtattggtgaattgcacgaaggtgcattgctggtactttcacagggacgagtcgtcgatatcgatgacgcggtagcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacttgttggcgcaggatagccgtttgcgggaagaactggtgatgaacctgattcaggcagaggagaatactcccgcacttactgaatgggcgcaacggctggggatcgatctcaatcaaccgcgagtggtggctattgttgaggtcgacagcggtcagcttggcgtggacagcgcaatggcggagttacaacaactgcaaaacgcgctgactacgcccgagcgtaataatctggtggcgattgtctcgctaaccgaaatggtggtgttgaaaccggcgttgaactcttttgggcgctgggatgcagaagatcatcgtaagcgagttgaacaactgattacccgcatgaaagagtacggccagctgcgttttcgcgtttcactgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaaacgatggacaataacggcttgctgcgacgaacgctggcggcgtggtttcgccacaatgtgcaaccgctggcaacgtcaaaggcgttgtttattcatcgtaataccctggagtatcggcttaatcgtatatcggaactgaccgggcttgatttgggcaattttgatgacaggttgctgctgtatgtggcgttacaactggatgaagagcggtaggttatgcgttaaggttgaggcggcgctggctcattcccctcagcccgaagggtagaggggaatgcccgaattaaccgtcagttcgggattatttacgcgttagtttttccagatcggcttcaatctcgctgatcttattggttacgactgactccaggtgacgtaagtcgtcgaggatcttacgcttaagatcaacttcgctgcggtcacgctggcagatttgatcaagctcatcaatgatataccgtagattcgggctgatttcctggacttctttataaccctgacccacaccatcagcgacgaccgttttacgctgacgcggatatttaaacttaacgctcttggcgaaaaactcgcctttgtctttctggaaatagattttcagaatatcgttgttggcttcctgccggaggctgtaacgatcaatttcttcaggattggtaatacccagacttttcagattgtcgtacatagcgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattctggtgataaaattcacgatctacaccagttccagcatcgttacttccgggcggcagttcagacgcaaaccatacaaactgcccacgccacgggttgtgtagatgtgtctttcgccaaaggcatttaatccggcgacgtaacgtttatcttcgacaggggcaaaaggttcaccaaccaacggtacgcgcagttgcccgccgtgagtatggccgcacagcatcagatcccagggttcatcacgcatgacttctttgctgtcgggattatgcgccagcaccagtcttggcagattggcttcgctggcgggaggcggtttgcattgtccggcccataagtcaccagtgcctaccagttcgaattgcctgttcggcgtggcgatcaccgtagcctggttaaacaacaccgtgatgcccgctgatttcaacgtctcgccaattaagtgatttttttctgtaccaacagggcgatcgtggttgccgaagcaggcaaacgtcggcgcacattcggcaaggggggagagtacgtcactaaacgccgaaaaattcagcgacatatcaaataatacgtaatcgccgcccagtaatatcaaatcgggcttttgttctatgccaagagcaatcgcgtcagaaatcaggcttaaaggaacaaaacgagagtaatggagatcggccagaaaaagaattttgaatggtgctgcgttgtctttaaaaaaggcgaggcggtgacggattaattcaaaccagcctggctcacagtaatgcatataaccgaaacctgagctcgtggctatcgtcgcggcagtagcctgcaaaaatcggcggcgtgaaatcatcgctcatccctgcaaaaaaatcgggcagcgtcgtgctgcccgtgtgcatacttttagtcgatggtacgcagcagttcgttaatgccgactttgccgcgagttttcgcgtcaactttcttaacgataaccgcacagtagaggctgtatttgccatcttttgacggcagattacctgaaacaaccacagaccccgccggaacgcgaccgtagtggatttcgccggtttcacggtcgtaaatacgggtgctctgaccaatgtatacgcccatggaaatgacggaaccttcttcgacaatcaccccttcaaccacttcagagcgcgcgccgatgaagcaattatcttcaatgatggttgggttagcctgcagcggttccagcacgccgccgatgcccacgccaccggaaaggtggacgtttttaccaatctgcgcacaagaaccgacggtcgcccaggtatcaaccatggtgccttcatcaacatatgcgccgatgttgacgtaagacggcatcagcacggtgttacgggcaataaacgcaccctgacgtaccgccgctggtggcacaacgcggaagccttctttctggaaacgtgcttcgtcgtagtcggcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcaccatgaagcgaaattcccagatcggcaaaaattttcccgactcgcgccagcagtccaggttggtcgagggcgatcagttcgaggaacgatttgcggtcggtatgggtcggcaaaaacgttacttcggtttcaacagtaaaatggcgtaatttggcgggttggcgacggggctgcggtggctgccagctactttgcgtcagtacttgctccagaccaaaccgaataacctcatgacgatctgcggacagcgggttgccatcgggttccagcacgataaaggtatccatcgccataccgtcgcgagtggtgaaaatttgtgcgtcgtgaacacttaaattgcggcggtctaattcggcacagacggcggcaaacagataagggcggtccgggctccagataaaaatctcggtgcctccacgcgtagcctgcgggctaagcaataccagcggtttgcttaaatcatgctgtaataaatggcgggcatgccaggccagttgatttgggctatggcggacaaaatagttagcacgacagcgtgaccaaatttggtgcagcgcctcttcgtcgatgttatccatgcgcagtagtgccagtgcctggagttggtgatggcgaacccgttcgcgcatatccggcgtgttttgcattccgcgtcgtagctgcttttcggtggcaaagtagagctcacgcaacagactttgcttccagctattccacagcgtttcgttggtggcgcaaatgtcagccacagtcaggcataccagatagcgcagacgattttccgtttgcacttcttcggcaaactgcttgatgacttccgggtcctgaatatcgcggcgttgggcggtcaccgacatcaacaggtgctggcgaaccagccaggcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcgtggaacagatcaaactgcatctgcccgacgatatgcgaccattgcggcatatacgcgccgagcacgctatggcgatgcattggcaatagcccgcgccgcaccgctccggggtgacgcagaatgctcaaaaacagttttcgtgcttccggaatattacacagcggttgttgcagatggcgacgggcatggcgtaactggcgcagcgtggtggagtaaatgccggtgatcgcactgttgtgcaccatggtgtagaacatacgcaagatggcttccggctggcgcataaatagtgtttcatcacgcaggtcgattagcgtaccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcagacgctgggcgacgctaagctggcgatcgaataacaggcgattatcgtaacggctgacgaccagatgcagggcaaagcgaatacgccacaatatatgcagacattcgtttaattccgcccgctccgctgaggttaagaagccaaacccgaccatttcatccagcgatgttgcgccaaaatgacggcgggccacccattgcagagtgtggatatcgcgcaagccgccagggctgcttttgatgtctggttcaaggttgtagctggtgccatggtaacgctgatggcgctggttctgttcttcaactttcgccgcgtagaacttgtcggaaggccagaatccttcgctgaaaatatgtttttgcagttcgaggaacagcgcaacatcgccaattaataagcgggattcgattaaattggtggcgacggttaaatccgataacccttccagcatgcactcttcaagcgtgcgcacgctatgaccgacttccagctttacatcccagagcagcgttaacagctcgcccactttttgcgcctgatcgtccgggagctttttacggcttaaaatcagtaaatcgacgtctgaaagtggatgcagctcgccacgaccgtagccaccgacggcgaccaatgccaggtcggcaatctggctgaatcccgcttcaatccataatcgttgcaggagctggtcgataaactcggtgcgcgcctcaatcaactgttctgcagagatcccattgtcaaaggcatcacccagccaacgctggaaagtatcgatatgggcttttatcccaccgacggttaattcatcacggggccagacgcatggattttgcggttgaccgggcagggtggggagagcggtgtttgcgtactgttctggaagggtattcattgtgcgccacccataagattaaattatcgcattaaaaaagccggcattcgccggcttcatcttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatcccaggtttcagtacgacgttggtttcacgggagtcatagtgcagcacctgcggttcttcatggaagccgcgaccaataccgtgtccgcaatattcacgaacgacggagaagccttctgcttcgacaaatttctgaatcgccgcaccgatttcgcgcagattaatgcctggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttagcatcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcgacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgcgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaagcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcttgataactcccccaaaatagttcgagttgcagaaaggcggcaagctcgagaattcccgggagcttacatcagtaagtgaccgggatgagcgagcgaagataacgcatctgcggcgcgaaatatgaagggggagagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagttctgaaagcacagttcgaagaagaacgtgttgcgctggtagcgaaaattggtgaaaacatcaacattcgccgcgttgctgcgctggaaggcgacgttctgggttcttatcagcacggtgcgcgtatcggcgttctggttgctgctaaaggcgctgacgaagagctggttaaacacatcgctatgcacgttgctgcaagcaagccagaattcatcaaaccggaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcaaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgtatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttaccgctgatccggcgaaagatccaaccgcaaccatgtacgagcaactgacttacagcgaagtgctggaaaaagagctgaaagtcatggacctggcggccttcacgctggctcgtgaccataaattaccgattcgtgttttcaatatgaacaaaccgggtgcgctgcgccgtgtggtaatgggtgaaaaagaagggactttaatcacggaataattcccgtgatggataaataagggtaagattccgcgtaagtatcgcgggggcgtaagtctggttataaggcgttattgttgcaggcagtttggtcacggccagcgcgcagcaaccggagcgtacaaaagtacgtgaggatggcgagcactgcccggggccaaaatggcaaataaaatagcctaataatccagacgattacccgtaatatgtttaatcagggctatacttagcacacttccactgtgtgtgactgtctggtctgactgagacaagttttcaaggattcgtaacgtgattagcgatatcagaaaagatgctgaagtacgcatggacaaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtacactgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaacgtgcgtcgtgacgcgaacgacaaagtgaaagcactgttgaaagataaagagatcagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcactcgcatggtagaacagtgcctggaattctctccccgctatgccgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgccggatcaagcctgccgtcatccgaactggtcgatggggcgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgttgctgcttttcttgcgcaacaaatccgctttacggatatcgctgcgttgaatttatccgtactggaaaaaatggatatgcgcgaaccacaatgtgtggacgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcagatatgccgtggttttacacggcttttttttgtataggcttcagtattcctgagtaccgtaaaccctgtcagggaataaaaaacgcgtgatgttgtctgctactcaaccacttagcgaaaaattgccagcgcatggctgccgtcatgttgcgatcattatggacggcaatggccgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctcgatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttatcggtggactcgctactgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggcgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacagtagcgccatttggcagcgaccaacggcgggatgtaaagctcgatttacgtcactgggcgtttgagcctgataaagaagatccggtatcttcgctggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaatggtaaagcgattggttttgtcggtattgagccgaaagtcattcctttgccagatgagtataaagttgtacgccagtatgggccgttcaacgccatcgtcgaagccacggacaaaacgtggcagctgatgaagctgacggtcagtatgctgggaaaattgatcaccggtgatgtgaaactgaacaacctcagtgggccgatctctatcgccaagggggctgggatgacagcggaactcggggttgtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgtaaaagctgtcgtgaccccgctgccgcgcaaccgtgttgacctaaaactggtgttccaggaaggtgtgtcagctgaaatccagcaaattaacattgttggtaaccatgctttcaccaccgacgaactgatctctcatttccaactgcgtgacgaagtgccgtggtggaacgtggtaggcgatcgtaaataccagaaacagaaactggcgggcgaccttgaaaccctgcgcagctactatctggatcgcggttatgcccgtttcaacatcgactctacccaggtcagtctgacgccagataaaaaaggtatttacgtcacggtgaacatcaccgaaggcgatcagtacaagctttctggcgttgaagtgagcggcaaccttgccgggcactccgctgaaattgagcagctgactaagatcgagccgggtgagctgtataacggcaccaaagtgaccaagatggaagatgacatcaaaaagcttctcggtcgctatggttatgcctatccgcgcgtacagtcgatgcccgaaattaacgatgccgacaaaaccgttaaattacgtgtgaacgttgatgcgggtaaccgtttctacgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaatcgtctgggcttctttgaaactgtcgataccgatacccaacgtgttccgggtagcccggaccaggttgatgtcgtctacaaggtaaaagagcgcaacaccggtagcttcaactttggtattggttacggtactgaaagtggcgtgagcttccaggctggtgtgcagcaggataactggttaggtacaggttatgctgttggtatcaacgggaccaaaaacgattaccagacctatgctgaactgtcggtaaccaacccgtacttcaccgtagatggcgtaagcctcggtggtcgtctcttctataatgacttccaggcagatgacgccgacctgtccgactataccaacaagagttatggtacagacgtgacgttgggcttcccgattaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattcctggatcggataacgaatactacaaagtgacgttagacacggcgacttatgtgccgatcgatgacgatcacaaatgggttgttctggggcgtacccgctggggttatggtgatggtttaggcggcaaagagatgccgttctacgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagacctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaacatgggcagcctgttccagcaggtagcgcagaaaaccggtgtttctaacacgctggaaaatgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaacgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaacccaaaataccgtgagcatttaggcttgtgccaggcgtccgcggttgtcatgacccaggacgatcttcctttcgcgaaaagtgccgcactggtagtgaagaatccctacctgacttacgcgcgcatggcgcaaattttagataccacgccgcagcccgcgcagaacattgcacccagtgcggtgatcgacgcgacggcgaagctgggtaacaacgtatcgattggcgctaacgcggtgattgagtccggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgcctgatccagtccggaacagtggtaggcgcagacggctttggttatgccaacgatcgtggtaactgggtgaagatcccacagattggtcgcgtaattattggcgatcgcgtggagatcggtgcctgcacaaccatcgatcgcggcgcgctggatgacactattattggcaatggcgtgatcattgataaccagtgccagattgcacataacgtcgtgattggcgacaatacggcggttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctgatacgtgattgataaatccgcctttgtgcatccaaccgccattgtggaagagggcgcgtcaattggcgcgaacgcacacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggttgacgacttcgcgatcatcggcggcatgaccgcagtccatcagttctgcatcattggtgcgcacgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgactgcggttagccgtcaggatgagaaactggatattaacatcgatgaagaagtgcatcgtctgcgtgaaaaaagcgtagaactgacacgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgctttaagatgcctatcatcacctttatcgacaccccgggggcttatcctggcgtgggcgcagaagagcgtggtcagtctgaagccattgcacgcaacctgcgtgaaatgtctcgcctcggcgtaccggtagtttgtacggttatcggtgaaggtggttctggcggtgcgctggcgattggcgtgggcgataaagtgaatatgctgcaatacagcacctattccgttatctcgccggaaggttgtgcgtccattctgtggaagagcgccgacaaagcgccgctggcggctgaagcgatgggtatcattgctccgcgtctgaaagaactgaaactgatcgactccatcatcccggaaccactgggtggtgctcaccgtaacccggaagcgatggcggcatcgttgaaagcgcaactgctggcggatctggccgatctcgacgtgttaagcactgaagatttaaaaaatcgtcgttatcagcgcctgatgagctacggttacgcgtaattcgcaaaagttctgaaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataacttgccagagcggcttccgggcgagtaacgtgctgttaacaaataaaggagacgttatgctgggtttaaaacaggttcaccatattgcgattattgcgacggattatgcggtgagcaaagctttctactgcgatattcttggtttcacgctgcaaagcgaagtctatcgcgaagcgcgcgactcatggaaaggggatttggcgcttaatgggcaatatgtgattgagcttttctcatttccgttcccgccggaacgacccagccgaccggaagcttgcggtctgcgtcatctggcttttagcgttgatgacatcgatgcggcagtggcgcaccttgaaagccataacgtgaagtgtgaaaccatccgtgtcgatccatacacgcaaaaacgcttcaccttctttaacgatccggacgggctgccgttggaactgtatgagcagtaaggcttgtcatcgccgcatttgcccggtaacgtgccgggcattgctactgtaaaatcgcaccatcatgacactcacgctcaatagacaacttctcacctcacgccagattctggtggcctttagcggcgggcttgactccaccgttctgctgcatcagttggtgcagtggcggacggaaaatccgggtgtcgctctgcgcgctattcatgtgcatcacggtttaagtgccaatgccgatgcctgggttacgcattgcgaaaacgtctgccaacagtggcaggtgccgctggtggtcgaacgcgtacaacttgcgcaagaaggactgggcattgaggcccaggcgcggcaggcacgttatcaggcatttgcccgcaccttgttgcccggtgaagtgctggtcaccgcgcaacatctcgacgatcaatgtgaaacctttctgctggcgctaaaacgcggcagtggccctgccgggctttcggctatggcggaagtctcggagtttgccggaacgcggcttattcgcccgttgctcgcccgcacgcggggggaactggtgcagtgggcgcgtcagtatgatttacgctggattgaagacgaaagtaatcaggacgactcatacgatcgtaactttctgcgcctgcgcgtagtgccgttattgcagcagcgttggccgcattttgccgaagcaacggcccgcagcgccgcactttgtgctgaacaagagagcctgctggatgaactgctggcagatgatttagcacactgtcaatcgccgcaggggacgctgcagattgtgccaatgctggcgatgagtgatgcccgccgcgcggcgattatccgccgctggctggcagggcagaatgcaccgatgccttcccgcgacgcgttggtgaggatctggcaggaagtggcgctggcgcgggaagatgcctcaccctgtttacgtttgggcgcgtttgaaatccgacgctatcagtcgcaactgtggtggattaaatccgtcaccgggcaaagcgaaaacattgtgccgtggcagacgtggcttcaaccgctggaattaccggcggggctgggaagtgtacagcttaatgcgggaggcgatattcgccctccgcgtgcagacgaagcggtcagcgtgcgtttcaaagcgccaggattgctgcatattgtcgggcgtaacggcggacgtaagctaaagaaaatctggcaagagctgggcgtgccgccgtggctacgtgacaccacgccactgctgttttatggcgaaacgctgattgcggcggcaggggtatttgtgacgcaagaaggtgtggctgaaggtgagaatggcgtaagttttgtctggcagaaaacgcttagttaagtgaaagccggataagacgcatcaaacgtcgcatccggcgaaagtcaatcaggattcgcttaccaccaccgtaccgatttccgggtggctaaagctggtaattttatccagacgcagctcgcgggtttcgccagcggcctcgacgaccaggtactccacatttttgcgggagactaaatcactggcttttgcctgcaatttttcgccatctttcagctcaagtgtcagcattaaatgatgctggcaggcgagctcaagattatcgtaatcatcacaattgattggttgatacgtatcattcattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgtatgatgctgcgcttgctggcgtggctgaaatatgctgatgaacgtctgcaatttacccgtggtttgtgtgccgatgatgagccggaagcgtggctgcgtaacgatcacctgggcattgatttgtggattgagctggggctgccggatgagcggcggattaagaaagcctgcacccaggccgcagaagtggcgctgtttacctataatagtcgggcggcgcaaatctggtggcagcaaaatcagagcaaatgtgtgcagtttgccaatctttccgtctggtatctggacgatgaacaactggcgaaagtaagcgcctttgccgatcgtaccatgacgctgcaggcaacgattcaggatggcgtgatctggttatcggatgataagaataatctggaagtgaacttaaccgcctggcaacaaccttcatgattgtgatttcccgacatgttgctattcccgatggtgagcttgagatcaccgccattcgtgcgcagggcgcgggcgggcagcatgttaataagacctcaacggctattcatctgcgttttgacattcgggcgtccagcctgccagagtattacaaagagcgtctgctcgccgccagccatcatttgatcagcagtgatggcgtgattgtcattaaggcacaggaataccgcagtcaggaactgaaccgcgaagcagctctggcccggctggtggctatgattaaagaattaacaacagaaaaaaaagcccgacgacccacgcggcccacccgtgcatcgaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcgcaggctgccgaactgaaaccgatgccgcaaagttggcgcggcgtgctgccgtgtgccgattgcgaaggaatcgaaacctctctgttcctcgaaaaagacggaacatgggtgatgaatgagcgttatctcggtgctcgtgaagaaccttcctccttcgcttcctacggtacatgggcgcgaaccgctgacaagctggtattaaccgacagcaaaggtgaaaagtcatattatcgggcgaaaggcgatgcgctggagatgctcgatcgtgaaggcaatccgattgaatcgcagttcaactatacgctggaagcggcacaatccagtttacctatgacgccgatgaccctgcggggcatgtatttttatatggctgatgcggcgaccttcactgattgcgcgaccggaaaacgtttcatggtagcgaataacgcagagctggagcgtagctacctggctgcgcgcggtcacagtgaaaaaccggtgttactgtcagtagaaggtcactttacgcttgagggtaatccggataccggtgcgccgactaaagtattggcacccgatacggcagggaaattttaccccaaccaggattgcagtagtttggggcagtaacccgtcttgagacagaaacaaacgcaaaacaggccagaaggatatatttcaacattttgaatttgcacgttttttgtaggccggataaggcgtttacgccgcatccggcaatggtgctcaacgcctgatgcgacgctggcgcgtcttatcatgcctacaacccccctcataccttaaggcggataaggcatttactttatcaccgggtcaaaccaacaaagcgacccgccttgatataaatcccaggcttcaggtgcccaacatactgtaactgcgtttctggcttaaacgcagagacatcaccaatacgcatatgcatcagatcggcagggctaatccagcccgattgcgccagtgtaagtggatgcccggctttggcaaaggcatccgtgacaaattccgaacaaaaccacgactttttgtctccttcgcccacactgcttaactgcgctttcgccaggccgctgacgcactgttggcgaaaatcctcggagaacggattcagtgagcacatctggcgagtcaccataaagggaataaattcgacaatgccgcgatagttataaccgctatctttgattttattggcaaacgcggtgatatctgtggcttgttgcggggtaagatccgggactcgtaagacgaaaagcttatcactatgcttcatcgcttttttaagggaaacgatctggacgccagcgcctgtcgcttctgcaacgttattatcacccagaaagattgcaacgtgactcacagaggaagtgctgaagacgcggattccaaatgaggttaccccaaggcttgaggagaacagcaaatcgccgggtttgagatcaggtgccgttatttcttttattgattgttcggtgaaagagctttgatgctggaatttgacagcccatgtttttgcctcggcatctactgctgtggctgatgggtctggctggctgatatcaacggtacaagccgaaagtaaaagaaagctggggagaaacaggcggcagtacgcctttggtttatccattttatacaatccatgtaaaaaaagggccctgaaattcaggaccctttctggcatcagcctttaatctgtttcaccagatattcgacgatgtcaccagtcttaattaactgtttctcgccgttgcgacgatatttatattcgatatcgtcgttgtcgaggttacggtcgcccagcacaatagtgtgcggaataccgatcagttccatatcagcaaacatcacgcccggacgctctttgcggtcatccagcagcacttcgataccttgtgcacgcagttcgctgtacagtttctcagcaagctcttgtacgcggaaggatttgtgcatgttcatcggcagaatcgccacctggaacggcgcgatagcgtcaggccatacgatgcctcgttcgtcgtagttctgctcaatcgccgcagctaccacacgcgttaccccgataccgtagcaacccatcgtcaggatttggttacggccatcttcaccctgtacggaggctttcagtgcttcggagtacttggtacccagctggaagatgtgaccaacttcgataccacgtttgatcagcagcctaccctggccatccgggcttggatcgccagccaccacgttacggatatctgcaacttccggggtagcgacatcgcgatcccagttgatgccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcgaaagtcagcgggcttgcaacctgcggcagtttttctgctttaacttcgttcagctcgtgatcaccgcgcaccagcagcgcaacctgcgggaagctgctgccttcaaccgctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaggtgtcggagaagaccacatcgtcttcaccgctctgcgccagcacctggaattcgtgagaggcgctgccgccgatagaaccggtgtcggcttgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctaagctcgttacgaatcaggtcagtgataacttcttcatgagttgggccgagtacgaacggacgctcgccacggtcaacaaaacgcagcagttccggaccgtactgttcccaacgaccactctcttgccacaaatcggctggctgaaccaccggcatcgacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgtagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaactcaccgccatctctgcagctggcgcactttgcgcatagctggcactggcatcgggaagcgattcggcaaaggggagatacggtttgatatccactaccggcgtaccatcgaccagatccagactgccgagcttcagaatcacgctgtctttatggcaaacaacctctttcagctctaccagcgacatgccaattgggttagggcggaaagtagagcgtgttgcgaaaacccccattctggcgttaccgccgaggcgcggtggacgcacagtcggacgccagccgccttccatcgtttgatgaaagacgaaaaggatccataaatggctgaacgcttccaggccgcgaacggcgtcggcctggttgtagggagcaatgagatgcagttcgccgttggcgctttttaccagacctggctggcgcggaacggcgaacttttctttatagggcgagcgaataacgcctatttgctcgaactggaaactgctcatttcgccgtaatgttaagcgcagaaccgatacatacagcctgacgatagcagcctggcgtaccgctggtgacttcgcagctatgcagtaatacagcattggctttcattttagaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggagcttgtaaaaatgacaagacgggcaagcgcccgtcctgaatgatattacaaattgtggaaacagcctaaaaattaccagcctttaacagctccgccgttaaacactttgtttgctgcttcgtaaacttcgtcagactgataagcctggacgaatttcttcacgttctcggcgtctttgttatcttcacgcgtcacgatcaggtttacgtacggggactctttatcttcaacaaagataccgtctttcgccggagtcaggccaatctggctggcataggtggtattgataactgccagagcgatttgcgcgtcgtccagagaacgcggcagttgcggtgcttccagttcaacaattttcagatttttggggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaaagtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccgatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttatagccgatgtagccatactgatagccaatctgacctaaaccaccggcaccgactgcaccacccatcgcggaataaccgaccagggtaatcagggtgatagttgccgcattcaccagacccggcagcgcttccggtaacagcaccttacggacgatctgcatcggcgtggcacccattgcgcgggaagcttcaattaacccggttgggatctccagcagagcgttctcgaccatacgggcaataaacggtgctgcaccaacggttaacggaacaatcgctgcctgcaaaccaatcgatgtaccgacaataacgcgggtaaacggaatcatccatacaagcaagataatgaacgggatggaacggaaaatgttcacaatcgcagaaacggtacgatacagcttcgcgttagcaataatttgccccggacgcgtgacataaagcagaacgccaaccggcagaccaatcacaaagccaaaaaaaccggatacgaaggtcattgccagcgtttcccatacgccacgaaccagcagccacatcatcggctcagacataacccagtacctctacttttacatggtgttcctgcagccaggcaatggcggcttgcgtatcttgttgtgtgccgtgcatttcagtcagcatgatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttctccattgctgatgaccgccacgcaatcacaaatgcgcttcacaacgtccatttcgtgggtgatcaacagaatcgtcaaccccagacggcggttgatgtctttcagcagttcgagaatagaacgtgtcgttgccgggtccagcgcgctggtggcttcatcacacagcaatactttgggattgctggctaacgcacgggcaattgccacacgttgtttctgcccaccggaaagattcgacgggtagctatcatgcttatcgccaagaccaaccaatgacagcaattccgtcacgcgacgtttgacctcgtctttcggtgtgttgtccagctccagcggcagagccacgttgccaaaaacagtacgcgaagagagcaggttaaaatgctggaaaatcataccaatctggcggcgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatctcgaatgcctgaaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggctatgtccatgagatcgacaactttgaatttatcgacggtgttattgacgccatgcgcgagctaaaaaaaatgggctttgcgctggtggtagtaaccaaccagtctggcattgctcgcggtaaatttaccgaagcacagtttgaaacgctgaccgagtggatggactggtcgctggcggaccgagatgtcgatctggatggtatctattattgcccgcatcatccgcagggtagtgttgaagagtttcgccaggtctgcgattgccgcaaaccacatccggggatgcttttgtcagcacgcgattatttgcatattgatatggccgcttcttatatggtgggcgataaattagaagatatgcaggcagcggttgcggcgaacgtgggaacaaaagtgctggtgcgtacgggtaaacctattacgcctgaagcagaaaacgcggcggattgggtgttaaatagcctggcagacctgccgcaagcgataaaaaagcagcaaaaaccggcacaatgattaaaagatgagcggttgaaataaaaatgcatttttccgcttgtcttcctgagccgactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaagagtgaacacgtaattcattacaaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtggttaaataaaaaatacttcagagtgtacctgcaaaggttcactgcgaagttttgctctttaaaaatctggatcaagctgaaaattgaaacactgaacaatgaaagttgttcgtgagtctctcaaattttcgcaacacgatgatggatcgcaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcatgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgtgaaggtgtactgtgaggtatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtctgtatatctattattgccagaatcgcaaaaatcctctgcattttacgctctttttcctcaacagtctgaagcccataatcacctcagttaacgaaaatagcattaaaagaggcatattatggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgctcgctaaggaaatcgataaaagcccggatgcgcgtacttaccgcacggtcgctgtaatagacggcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacgggctatcggccaggtattgagggaagcgggttcagtgaatcccaggcaaatatgttgctttaaatcgtcgatcgtttctggcttcccgtagcgggaaatataatcgggggaggcgataatttttcgataactgttaaataacggcctggcacgtaagctggaatccgttaacgtaccagcgcgtatcgcgacatccacttttctttcgatcaaattaataatcgtttcggaggagactagcgacaaagtgacttccggatagcgttcacggaaaggcttaattaacggcatcagaaagtgcagcaccactggagttgcggcatcgatccgtaacagtccacgcggtgtattacgcgtctccataatttctgattctgccgctgccatctcctgcaaaattgactgtacgcgacgaaaataacgctcgccttcttccgtcaggctaagttgtcgcgtggtccgattaagcaggctaacgccaagtttcatctccagctttttcaccgcccggcttaccgctgagtttgcttgccctaattgttccgctgcccggctaaagctgccgctttcgacgaccgaaacaaaaatggcgagttcttccgacgtggctttcatttttgctcctgttgcaaaatagaagagatattttgaatttatttgtcattaaaccatcaggatgcgtgatatgtcatgcgatttaatgttctccataatgagcaaaattctgaccggtgtaagcacttgcttacataacaatatacaattgctcgttgaaagagtgagctaaaatccctataacagtagaaccctcccgagtgcggaagggttgacgtaatagaggtttcaaagtcaaaagtgcgaaaaaacacctatgccatgcgctatgttgccggacaacctgcggaaaggatcttaccgccggggtcttttgcgagcatcggccaggcattaccacctggggaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgaccgctaactatcttgccgccgatcaggtacccgctttcgtgctgccacaacatccttctggcgtaatgaccctttcggcggcacatccagtgtattgctgcccgttacgtgaacgagaacccattttgcgtctggcgaagtcggcactggtgacggtctatccattacctgacacccgcctgttgatggtggttaatatacacgccgtcaacttcagtctgggcgtggatgtctatagtaagcagttacttcctattggcgatcagatagctcaccacagcggcccggtcattatggcgggagatttcaatgcctggagccgtagaaggatgaacgcgttatatcgctttgcgcgggaaatgtcgctgcgccaggtgcgttttaccgatgatcagcgccgtcgggcgtttggtcgcccgctcgattttgttttctaccgtggtctgaacgtcagtgaagcttctgtactggttacgcgcgcttccgatcacaatccgctactcgttgaattcagtcccggcaagcctgataaataaggtatgtcaggtctgccacagggcagaccaacgtttggcgctgcgcaaaacgtgagcgcggtggtggcgtatgacttatctgcccacatgctggatgtcgtggcacaagctgccgaagcccggcaactgaaaaatatcaccacccgccagggatatgccgaaagtctgccatttgccgataacgcatttgatattgttatcagccgttattctgcccatcactggcatgatgttggtgcagcactgcgagaagtgaataggatattgaaacctggcggtaggctgattgtgatggacgtaatgtctccgggtcacccagtgcgcgacatctggttacagacggtagaagcattacgcgatacctctcacgtacgaaactacgccagcggtgagtggttgacgttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgagaacgtattttgccttgcagaatgatggctttttcaccagtgatatcatcatggtagatgcacataaagcggcataaataaaaaaggcaccgggggaatcggtgcctttttattatctggtttgtcaggaatctggcatgttgttgtttttcacaaacaacgtcagcttatcgcctggttgcagattcgcagtgtcgctgttccagcgcatcacatctttgatgttcacgccgtggcgtttagcaatgcttgaaagcgaatcgcctttgcgcacacgatacgtaatgctatcgctgttgtttgccagtcgctgtgcgctactgcctgcaccaatcgtcaaactttggcctggcttcagcttagatccgcgcagtttgttccactgctgcaaatctttggtgcttacgccgagacgtgaagcgatacttgaaagcgtgtcgccagagcgtacggtgtaaacacggctgttaagcggcgtattgtcggcaaccagcgtcgactgtacagcagcaatttcgcctgaagccagagattcacgcagttgatctgcatgcttctttggcaccatcacgtactgcgggccacttgcgcccagcgtggagccttttacgccagcgttgaatgtcttcagcttgctgacggaaatccccgccatatctgctaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacattttgttcagacgctgcatcatattcagcgcggcagttgttgaagcaacaacatcgcgacgcgcgtcataattgcgggtctgtttcaaaccataattgcgccccgtgctcggaatgatctgccagatgcctgcggcattggcgccagacgttgcgtgaggatcaaaagcgctctccactatgggtagtagtaccagttccataggcatgttacgttttttaacttgccctgctatccagtacatatacggctctgcccgtaaagttacatcgtggagatagctcttattgcgtaaatatttctgtttctgttcgcgaatccggtcattttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtactctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgctcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaagtgattgatacatttgtgatgctgtcccttcaaacaaccgaccacacccaccagaaaacagtgtgtcgccgcaaaatagataaggtttactgaagtaacagatatgtcctaaagtgtgacccggcgtagcaattacactaaattcatgccccaaaacgaaggcagtttcgccatctttgactacctgtgttgttcccttatcttgtgtctcttgtggaccatacaccacaatttgtggaaacttttccaccagttcttttacgccgccaacgtgatcgtggtgatggtgggtgagaaatatggcctccggttgccagttattggcggcaatggcgtttaatactggctctgcgtctccgggatcgacaatcaggcagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggaaagctttatcgcaaggcgctggagcgccagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtacaggcggacccacttcatcttccttttgccgataaatccgttgatgtttgtctactggcacatacattgccgtggtgcaccgatccgcatcgtttattgcgtgaagccgatcgggtattgattgatgatggctggctggtcattagtggcttcaatcccatcagttttatgggattacgcaaacttgtgccggtattgcgcaaaacctcgccctataacagccggatgtttactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagtaaaaacaagccacgaattcgccaggcggttggagccacccggcaatgtcgtaaaccacaggcttaaacttcaacttggtagcctgtatcttccagtgtgggattcatcgccgcggcacgagccagttcatcacagcgttcgttttccgggtgtccggcatggcctttaacccattcccatttgatttgatgctgccccaatgcagcatcaagacgttgccagagatcgacattttttactggttttttgtctgcggttttccagccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtcctggattgcccagacacgaaccatcggtgaaaatttctacctgtttaagcatctctggtagacttcctgtaattgaatcgaactgtaaaacgacaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatacctgtgaaaggcgctaaaaatagcgacttgggcgatttttgcagcaaacgattcaaaagatgagaaaaaccgttgacgaaggtcgaggcaatccgtaatattcgcctcgttcccaacggaacacaacgcggagcggtagttcagtcggttagaatacctgcctgtcacgcagggggtcgcgggttcgagtcccgtccgttccgccactattcactcatgaaaatgagttcagagagccgcaagatttttaattttgcggtttttttgtatttgaattccaccatttctctgttcaatgattttactctggcgtaggtgcgtgattctcgcttgttgtctcattcattaaaattcaataatgatatcgaaccattcagcttaaatatatttctagagaataaatttatattgattaaatgaatgtatatttcaaattgattttgtttgttattatttaagtgaggtatataattagagtccgttatcaatgctaaatattctaatcattatgacaggcgagggagtgtccaattatgaattcaaaaaagctttgttgcatatgtgtgttattctcgctgcttgcaggatgtgcctctgaatcttctattgatgaaaagaagaaaaaagctcaagtcacacaaagtaatattaataaaaacactccccagcaactgacagacaaagatttattcggtaatgaaaccactctggccgtatccgaagaggatattcaagctgcgcttgatggagatgagttccgcgttccccttaattctcctgtaatacttgttcaatccggcaaccgcgcaccggaaaccattatgcaggaggagatgcgaaaatattatactgtttccacattctctggtatcccggacaggcaaaagcctctgacttgtaacaaaaacaaagataaaaatgagaacgaggatgttgccagtgctgagaatatgaactggatgcaggcactgcgttttgtggctgcaaaaggacatcagaaagcgattattgtttaccaggatatgttgcagacaggaaaatatgactctgcgctgaaatcaacagtatggtccgactataaaaatgacaaactcactgacgctatctccctgcgctacctggtacgtttcacgctggtggatgtggcaacaggtgagtgggctacctggtcgccggtgaattatgaatataaagtgcttccaccattgcccgacaagaatgaagccagtacgactgatatgacagagcagcaaatcatgcaacttaagcaaaagacctataaagcgatggtaaaagatttggttaaccgctatcaataataaattatatctgccgccaggaatttctggcggcaataatacaaaattctttgcataagaaatttttcttgacaaagacagtgcaagaaaggacatggaatccggagttaaaaactgtttgttttagaatatttaattatttaactgctgaatcttccttgcgagaaatatatccattattacatttcatgccatttttaatatagattgctcctgggaaaattcccgtattattaccgcaggggtgataattagtattgacatatcctgtgacaaaaggagctattaaaggtgctattacgatagctattagtaaaaatataagagttagctgtattgttatgtctgtggcgaaattgactaccttcgtttttttgattaagaatgattttattatcgtaagtaaaattacatgaatatttaaaaaggaaaacgacatgaaaccgaagcacagaatcaacattctccaatcataaaatatttccgtggagcattttattattgaatatagaggtttaactccggtaaaaaacaaagaagcattgaatgcagggaaaaataatatggccataaaaaacatcgaaagaaactcttttaatttaacatgtaaacgcatggttaatcctcatatcacgggtggagtgttaagaacatacataaatggagtcatgttttcccttttccatttatcaagttcctgttgccgttttagtccatctctaattgcatattttaatttttctgataaatggcattgagcatcgatttcatttaaaacaactgtacacactatccctgtcagtaaaattgctcctccgacaagaattactggaaagccaaagctaacacaggcaaaagaagccagacttccaatagcggttgcaacaccaccggctataactgctttggccacatccattgaaaaatcgccaagaaaattaaccagatctcgctctgaactcataataaattctatggttctgctgatttaaccgcagagaagttcgccacagcaatccgaaaccactggcacgtggagaataagctgcacaggcgtctggacgtggtaatgaatgaagacgactacaaaataagaagaggaaacgcagcagaattattttcagggatacggcacattgctattaatattttgacgaatgagaaggtattcaaggcagggttaagacgtaagatgcgaaaagcagccatggacagaaactacctggcgtcagtccttgcggggagcgggctttcgtagtaataccccgactctccccgtccttaaacacaacccccactcaccacaacctaaactcatccgcatcctgccatgccggaaacttttctctatattcccgcaatgctgccatcgacagctccgcatcaatgcgcgttgcctgatgcgcgtcggcagtagcgataatctctccttgcggattaatcacccggctgtcaccgcgataatggcagccgttgccatcgctgccgacgcgattgcatcccgccacatacgcctgattctcaatcgcgcgggccgtcagcaatgcctgccagtgcagagagcgcggagcaggccagttggcgacgtacagggcgaggtcataatcgttgagattgcgcgaccacacaggaaaacgtaagtcgtagcacaccagcggcaaaatacgccagccgcgccattccacaatcactcgcgcattgcccgctttataatgtagatgctcatctgccatgcggaacagatgacgcttatcataaaaatgtaccgtgccgcccggctcaaccagcaaaaagcggttaaccgaaccagactccgtttgtaatgcaacactgcctgcaatcagcgcattgcactgctgcgccttagctgtcatccagttcactacgtcatcttgtgctagcgacgaagctgccgcttccatggcaaagccgctggtaaacatctccggtagaacgatcacatcgcgcccggtaataccttccagttgacgatcaaaatgacgcaggttggcaggaccatccatccacaccagtggttgctgcaaaagcgtaatcttcaaaccaggcacggtgtacaactcctttatgcgaagggttttataactttaacaccttatcaggcagttgccttagcgcagaataaattgataacaaatgctgatattggaaatatctgatttgcaaattatcgtgttatcgccaggctttaggaggttaataacatgggcaggataagctcgggaggaatgatgtttaaggcaataacgacagtcgccgctctggtcatcgccaccagtgcaatggcgcaggatgatttaaccattagcagccttgcaaagggcgaaaccaccaaagctgcatttaatcagatggtacaagggcataagctgcctgcctgggtgatgaaaggcggtacttatactcccgcacaaaccgtaacgttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggctgaatgtgaacgatgcgctttcgattgatggtaaaacggtgttgttcgcggcgttgaccggcagcctggaaaaccatccggatggctttaattttaaataattagcggataaagaaacggagcctttcggctccgttattcatttacgcggcttcaactttccgcactttctccggcaactttaccggcttcgtcgccagctcttccggatcaaagtcatcaacgttaatactgcgcagacggctttcttcagctttcaccagaatagcggcttcatctttatcaatcagccccttcaccagcgcgttgtgcgccagttcatccagacgggtaaacggcaggtttttacccagctctttacagatccgctgatgaattgggtcggcggcaatcacatccaccagcgcctcttccagcaagccaaccggattatgctcgctcggcgtcaggtactgaccgcgaccaatgcgggaacgggtggcgttcggcacttgtaaaatcttcgccactttatgatccagcttgtcagaaggtgccagataatgacgtccggtcgggaagatcaccacattcagcagcccggcaaccacgcggttcgggaagttttgcagtaaatcatccatcgcctgttcagcctgatacagcgcatcttgtacgccccagtgcaccagcggcaggtcggcttcattacggccttcgtcgtcataacgcttcagcacggcagaggcgaggtagagctggcttaaaatatcccccagacgggccgagatgcgctcgcgacgtttcaggctgccgcccagcactgccatcgagacatcagaaagcagggcgaggttggcgctcaggcggttcaggtgctgatagtagcgtttagtggcatcgccggttggcgtgctgctggttaaaccgcgcgtcaggcccagccagaagctgcgaactttgttgctaccgacgtgaccgatatgtttgaacaacagtttatcgaacgcgttgacgtcattgttcttcgccgcttccatctcttccagcacgtacggatggcaacgaatcgctccttgtccgaagatcatcatgctgcgggtcagaatgttagccccttcaacggtgatggcaatcggtgcgccctggtaagcacgcgccaggaagttgctttgcccgagcataatgcctttaccgccggtaatatccatcgcatcaataatcgactgctgcccgcggtgggtacagtgatacttaacgatagccgacagcacggcaggtttttcgccgagcataatgccgtaggtaatcagcgatgccgcagcatccatcacgtaggcattaccggcaatacgcgccagcggctcttcaatcccttccatcttaccaatagagattttgaactgacggcgaatgtgagcatacgcgccggttgccagcgctaccgatttcacgccgccggttgagttggaaggcagggtgatgccgcggcctaccgagaggcactccaccagcatccgccagccttgcccggccattttcggcccgccgatgatgtaatcgatcggcacgaagacatctttaccgcgcgtcggtccgttctggaacggtacgttcagcgggaagtggcgacgaccaatttccacgcccggcgtggtggttgggatcagcgcacaggtaatgcctaaatcttctgcaccgccgagtaatttttccgggtcggagagtttaaacgccagcccaagcacggtcgcaatcggtgccagcgtaatgtagcgtttgttccaggtcagacgcatccccagcacctgctggccctgccattcgcccatgcagacaatcccggtgtccggaatcgcgcccgcatcggaacccgcttccgggctggtcagtgcaaagcaggggatctcctgaccacgcgccagacgcggcagatagtgatctttctgctcgtcagtgccgtaatgttgcaacagttcgcccgggcctaatgagtttggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccacaactccggcggcagatccgccagctcatgggtgatctggaaatcattcgccatccggcaggcttcttctaccgggccgtcgagaaacgcttgctcttcggcggtcaggcgcggctgcggatagttatgcagctttttccagtccggcttgccctggaacaagtcgccctcccaccaggtggtgcccgcatcaatcgcttctttctcagtgcgcgacatcggcggcatcaccttacggaaaccgcgaaataccggcgcggaaatcatcgacttacgcataggcgcaaagttaaatggcacgaggataatggccagaggcaccagtacccacgccgaccacagaccagcaacgccgagggcggctgtccaggcgagcaaaatcagactgctgataaataagctcacgcggtgatagaacaacgcgccgagcaggacaaccgtagcgagaatactcaaaatcatcataacgaaaagccccttacttgtaggaggtctgaccacttgtgatgatatggttgtagtggatgtaaaaacatttagcaatatgtttacaatataattacaacaaagctcacattgttgctgtttttatccgcacttcaggtcaaaaagtcctggtcatagcacctgcccgtacttctcgcttttggcggtatccggtacactgcattttgtctattacatttatgctgaaggatatcctcatgtaccaggatcttattcgtaacgaactgaacgaagcggcggaaacgctggctaactttttaaaagatgacgccaatattcacgccattcagcgcgcggcggtcctgttagcagacagctttaaagccggtggcaaagtgctttcctgcggcaacggcggttcccattgcgacgctatgcactttgccgaagagttgaccggtcgctaccgtgaaaaccgtccgggctacccggcgattgctatttctgacgttagtcatatttcctgcgtcggtaatgatttcggtttcaatgatattttctcccgctacgttgaagcggtaggtcgcgaaggcgatgtactgctggggatctccacctccggtaactctgcaaacgtgatcaaagcgatcgcagcggcgcgtgagaagggaatgaaagtgatcaccctgaccggtaaagacggcggcaaaatggctggcacggcggatatcgaaattcgcgtaccgcactttggttatgccgaccgcattcaggagattcacattaaagtgatccatatcctgatccagttgattgaaaaagagatggttaagtaagtctggcgtaggccggataagacgtttacgccgcatccggcatttgtgcgctgatgcctgatgcgacgctgacgcgtcttatcatgcctacaaatctgtacgcgaaccgtaggccgaataatgcgttcacgccgcatccgacctgaaaattcttaaatcaatcttcgccgggggccatgcgctcccgctgttgtggaggttacccatgtgcgaattgctcgggatgagcgccaacgtccctaccgatatctgctttagtttcaccgggcttgtacagcgtggtggtggaaccgggccacataaagatggctggggcattaccttttacgaaggtaaaggctgtcgcacatttaaagatccacaacccagctttaattcccccatcgccaaacttgtccaggactacccgataaaatcctgttcggtggtggctcatattcgccaggctaatcggggcgaggtggcgctggaaaatactcacccatttacccgcgagttatgggggcgtaactggacttatgcccataacggacaactgacgggctacaaatcactggaaaccggcaacttccgcccggtaggcgaaaccgacagcgaaaaagccttctgctggctcctgcataaattaacgcagcgttacccgcgcacaccgggcaacatggcggcggtatttaaatatatcgcctcactggcggatgaactgcggcagaagggcgttttcaacatgctgctttcggacgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcaacacagccgctgacgggcaatgaaacctggcaaaagattatgccaggcgaatggcgcttattttgcctcggggagcgtgtagtttgatgccagttgtggctgcacaacttcgtggcttaacggcttgctgaccacgtaacgaccattgaccacagaaacggttggtggcttacgggtttgctcaaagtagtcgtaacccggcttcagttgctcccagaagtccttaaagttggaatatttatggcgcttcatattggcgtcggtcatgcggaacgggtaaatactcacttgcacgctcggctgaccaaacaccagcgcaccagtaacgaactggaatatctcatcaataccctgattggtcattgcgtagcagccgatggaaacacaatcgccgtggatcatcaggtatttcccttcataaccatgcgcacggtcataggcattggggaaaccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcacaggcgtggtagagctactgctgcccagcaaaccggcaaatgaaacgcacgggatcaacaacatcgcaagaattaatgcgattttacgcatactgcttattccttgataaaacggttacacacgccaggacggcaaaatggatcccaaatcggaatagtctggatttggaaggctcacattatcaccaaaagagttttacgcaagcctgtcggcgcagggtttacaaatttcatcggaagcgggctttacccaaagagcgccgcgtgagttccagttctctcaaatcgtaaaagtttatcggtaagtttgtaaatcaggatccagtccggttcgacatgagcatcgcgataacctttccatgaaccttgcagcgggtggtctttataaacagctggaagcggtaaagtattattgataagaagcgtcataagatatttcaatttattcatatccttatgacgcttttgtgcaagttttacatcctttgaatattgtcccgagtattcaatatccctttgaatcatatttaaattcctaatttatcaaataaatcatcggcgtctttggccttatgaacatcaatgccagcttcgctgtttttgattgattgaatggttaattgattaggctcgcgtaaatcaaacggcaatgccttttcacgcgcgacctttgtgagggttatgcgaaccaggtcagagatggtcagccccatcccggccagtacgtccgctgcctgattcttcagatcttcatcgattcgggcgcgaacaaacgcgttagcagccattggggtatctcctgtgctgtatatttattcagcttgaattgtagctcaaatgagcaacagcgacaatccatgagtaatttaataaacggatgtttttacataattaactgaaatatatatgttaattttataataatggtttattaagtttgttcagaaacgatccgggatacactgcaacattaaagcatgaccagccattattgagtatgtccttgccgtcgattccatcctttgtattgtcgggattactgttgatttgtttgccgttttcttcatttgccagcgccaccacatcacatatctctttcagctacgccgcccgccagcggatgcaaaaccgtgcgcgtttattaaaacagtaccaaactcatctgaaaaagcaggccagctatattgtggaaggcaatgccgaaagcaaaagggcgctacgccagcacaaccgggagcagataaaacagcatccagaatggtttcctgctccgctcaaggcgagtgacagacgctggcaggcgctggcggaaaacaaccactttttaagcagcgaccatctgcataacattaccgaagtggcgattcaccgcctggagcagcagcttggcaagccttacgtctggggcggtacgcggcctgataaaggctttgactgtagcgggttggttttttatgcctacaacaagatccttgaggctaagctcccgcgcacggccaatgagatgtaccactatcgccgggcaacgattgtggcgaacaacgacctgcgccggggagatttgctgtttttccatatccacagccgcgagatagccgatcatatgggcgtgtatttgggcgatgggcaatttatcgagtcgccacgtaccggcgaaaccattcggataagccgattagccgaacctttctggcaggaccattttttgggcgcgcgcaggattttgacggaagagacgattttgtaggacggataaggcgtttacgccgcatccggcagttgtacgcaggtgcctgatgcgacgctggcgcgtcttatcatgcctacgagcccgcgaatatttgcgagccgctttcccgatataaaacaacctcattgccaacctttccttttcttcttaccgttgagaaaaaggagtcgccatgtctgaatatcgtcgttattacatcaaggggggaacatggtttttcacggtgaatttacgaaatcgtcgaagccaacttttgaccacccagtaccagatgctccgtcacgccattattaaagttaagcgagacaggccttttgaaatcaacgcctgggtcgttttgccagagcatatgcactgtatctggacattacctgaaggcgatgatgatttttcctcgcgctggcgggaaattaaaaagcaatttacccatgcttgtggattgaaaaatatctggcaaccacgtttttgggagcacgccatccgcaataccaaagattataggcatcatgttgattatatttatataaatccagtaaagcatggttgggtaaagcaagtgagtgattggccattctcaacgttccatcgcgatgtcgcgcgagggttatatcccatcgattgggcgggggacgtaacggattttagtgccggggagcgtatcatttcataattgtgcgcagatgcctgatgcgacgctagcgcgtcttatcatgcctacaaacttgtgccggatcggtaggccggataaggcgtttatgccgcatccggcagttatgcgcagatgcctgatgcgacgctggcgcgtcttatcatgcctacaaacttgtgcctgaacggtaggacggataaggcgttcacgccgcatccggcagttgtgcaccaatgctggatacttacatcaacgcccccataatcttcaactccagctcatccggcacttcgttatacgacagcacatgcagccccggcgcaaacaaccttgcataacgcgccagcaaagggcgcagctgcggtggcaccagcagcaccgggtctttccccgccgctttcatctgctctttcacctgtggcatcgtactctggaactggttgagcatattcggatcgaccggcacgctgtcgagcatcactttcccgccctgttgcgcctgattcaccacgttggtcagcagattttccagctcattattcagcgtatacaccgtcagctcctgcttgcgaacgaacggatgggtaatgctgcgccgcaatgccaggcgcacatcggccgccagcagaatatgatctttcgtcaccgtgctactggcgaccagcacggtggcgatggtgacgatatcgcgcagggaaacgccttcggtcagcagcgcccggtacactttcagcaactggctgtaattgagcgccgcgctcaaatcttccgccagacgcggtgccgtcgacgataaacggttatgcaactgcgtaatatcatcatagttaaacaaatcaggaatatagctgcgcacaatcttatttacatgggtagcgatcacgctggcgctgtcgatcacctgataccccatattcagcgccttcgctttctgcgccgcctggatccaggtgaccggcatcccgtacgccgggtcgttcccctgcacgccgtcaatctcgccgtaggtttcgctggagggcagggccatcagtttatccgccggaatatccgcttcatcagcctttatgccgttgatgaaaatggcgtactgactgggcttaaggcggaagttttcccgaatgcggatctccggcagcagcacgccgttgccgtcagaaatcacctgccgcacgccgcgaatccgctgggtgagcgggttaccctgtgctttgtccaccagcgccaccagtttgtaaccgaggcttaaactgataggctcgatcagcggaatggtttcccaactgacctgctgctcgctggtttcggtgatggtgcgggtcagcgtttcgaggcttttctcttccgcctccgccgccagcggctgtttgctcatccgccagccggtaaaaccaagcagggcgctgaacagcaaaaacggcaggtgcggcattcccggtaccaccgccagcacgaacataatcccggtggcggtgtagagcaccgacgggcttgccagcagctggttacgcacgtcatgggcgatatcgccgttgtcgctgacgcgggtgacgataatcgccgccgcggtggagagcagcagggaagggatctgcgccaccaggccgtcgccgatggtcatcagcacatactgctggaaggcagcatcggcgctcaggttgtatttgaagatcccgatacagacgccgccgatcaggttgatcgccagaatcatcatcccggcgatggcgtccccgcgcacaaacttcgatgccccgtccatcgcgccgtagaaatcggcctcgctggcaacatctttacgccgggtttgcgcctgcgcctggttgatcaatccggcgttaagatcggcgtcaatcgccatctgtttgccgggcatcgcgtctaaggtaaagcgggcagaaacctcggaaatacgctcggcccctttggtgacgacaataaagttgattgtcaacagcgtcagtaaatccgagcgtgaaagcattatcgccgcgctgcacgggcagtcgatttttaacggtggtgggctgtcgccgttaaataaaatcagcccgtctcatccgccaaaacctgccaccgtggcggtgccggaagagacggagaaaaaagcgcgtgatgtgaatgagaaaacggcgctgctgaagaagaaatccgccaccgagcttggtgagctggcaaccagtatcaacaccattgcccgtgatgcgcatatggaagcgaatctggagatggagattgttccccagggattacgcgtgctgattaaagacgaccagaaccgcaatatgtttgaacgcggcagcgcgaagattatgccgttctttaaaacgctgctggtggagctcgcgccagtgttcgactcgctcgataataaaattattattaccgggcataccgatgcgatggcctacaaaaacaatatctacaacaactggaacctttcgggtgaccgcgcgctttcggctcgtcgggtgctggaagaggccggaatgccggaagataaagtgatgcaggtaagcgcaatggcggaccagatgctgctggattccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgaacgcgttaaatgctgaatctttacgcatttctcaaaccctgaaatcactgtatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgatgtatactattatgtatattctggtgtgcattattatgagggtatcactgtatgcatcgaattctcgctgaaaaatcggtcaatatcactgagttacgtaaaaacccagctaaatactttattgatcaaccggttgcggttctttctaataatcgccccgcaggatatctcttaagtgccagcgcattcgaagcgttaatggacatgcttgctgaacaagaggagaaaaagcccataaaggcgcgcttccgtccaagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgatgcgttaacggcggattttatttcctataagcgtgacggtgttttgccagatatatttggtcgcgatgcactctacgacgactcctttacctggccattaatcaaatttgagcgagttgctcatattcatctggcaaatgagaataatccatttccgccacagttgcgccaattcagcagaacgaatgacgaagcgcatttggtatattgtcagggggcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggcgattttcagcaactatgcgctattttcattagagcggttacgatgaccgccagtcagcattattcaccacaacaaatttccgcctgggcgcagattgacgaatctcgctggaaggagaaactcgcgaaatcacaagtgtgggttgcgatcattaatgcacaaccggttggttttatttcccgcattgaacattatatcgatatgttatttgttgaccctgaatacacccgccgtggggttgccagcgctttgttaaaacctttgattaagtctgaatccgaacttacggtggacgcaagcataaccgcaaaacccttttttgaacgttatggttttcagacagttaagcagcagcgcgttgaatgccggggagcgtggtttactaatttttatatgcgatataaaccgcaacattaaatccagcttgcaatgaaaataacgcccgcctggtatgtgcgcgttttctgattccacaaactgcaaggaggtaaatcatgacaaatcctttatcaatgactctttgcagacctttccaggattaattctttttttcttgccctggattcgtctgccatttcctgatttttatatttatatactctaaataattcgagttgcaggaaggcgacaagcgagtgaatcgccaggagcttacataagtaagtgactggggtgaacgaacgcagtcgcagtacatgcaacttgaagtatgacgagtataaatggaatggtacatgggcaaatatattcgtcccttatccgatgcggtatttaccatcgcatctgatgacctgtggatcgagagtttagcgatccaacaattacacaccacggcaaatttacccaacatgcagcgcgtagtggggatgccagatttacaccccggacgcggctacccgattggcgcagcgttcttctctgttggtcgtttttacccggcaagacgtcgcggtaacggtgctggaaacagaaacgggccgctactctgacacactgcgttcggcgctggtttctctcgatggcgataacgcatgggcattaagcgaaagctggtgtggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcaacagcaacaggaaaatagcgcggcgctgaaatcgcagcggcgaatgttccatcaccagattgaacgtggcaacccgcgacggacatttacagggatggcttttatcgaaggataatgaaggatgaaactgccggaaggcgattaaacgccatccggcagcaaatcaaataattacttcgccggaatttctttcagcagttcagtcagcagtgtccagtaatgacctacgctttcgatgtgaacttgctcatccggagagtgtggaccggtgatagttggcccgatagaaaccatgtccatttccggatacggttttttgaacagaccacattccaggcccgcgtggataatctggatgttcggcgtcttgttgaacaggcgctgataggtttcacgtaccagatgcatcaccggagaattagcgtccggctgccagccaggatatgcgcctttcgcttcggttttcgcgccagccagtttacccagcgaatccagcatgctcaccacgtagtctttaccgctgtcgatcagtgaacggatcaggcagtgaatttctacgttattgtcagtcatggtcaccacaccgacgttcagggaggtttcaaccacacctttggctacatcggagttacgaatcacaccgttcggggtggcgttcagcagacgaataaaggtatcgcgagatttcgcaatcagggcagctttatcgttcgctacagagtccagcaacaaggccagatttttctctttttctgccagctcgtttttcaggatctcctgataggtattcaccagagatttcaggacgtcgactttatcagctgcgacagcaatggtcgcaaaggcttcacgcgggatggcgttacgcagtgtgccgccgttgaaatcgataaggcgcagatccagttcttccgcatgacccgccaggaagcgcaccagcagtttgttggcattacccagcccaacgtggatttccccgccggagtgaccgcctttcagaccttttaaggttaacttgaaggtttcaaaaccagctggaaccgcttcacgatctaaatgcaggttggaggtgaagtcgataccccccgcacaacccatgtagatttcaccttcttcttcggagtcggtgttaatcagaatatcagcctgcaaccagttgccctgtaagccgaacgcaccgtccataccggcttcttcggtcatggtcagcagcacttccagcgggccgtgaaccacgttttcgtcagccagaaccgccagcgcagaggccataccaatgccgttatccgcacccagcgtggtgccgcgcgctttaacccattcgccatcaatataaggctggataggatctttcgtgaagtcatgcacggtgtcgttatttttctgcggcaccatatcgaggtgggcctgtaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccacccaggcgatggtgtggcaacaaaaagcctgtgcggaagacgatccgcaactcagtggtcgtcactggctgcatgcggctacgttgtacaacattgccgcctatcctcatctgaaaggagatgacctggccgagcaagcgcaggctttgtcaaaccgcgcctatgaagaggccgctcagcgtctaccgggcacgatgcggcagatggagtttaccgtacccggcggtgcgcccatcaccggctttttgcatatgccgaaaggcgatggcccgttcccgacggtattaatgtgtggtggtctggatgcgatgcagacggactattacagcctgtatgaacgttattttgcgccgcgcggcattgcgatgctgactattgatatgccgtcggtgggcttttcttcaaaatggaagctcacccaggactccagcctgttgcatcagcacgtcttaaaggcgctgcctaacgtaccgtgggtggatcacactcgcgtcgcggcctttggtttccgtttcggcgctaacgttgccgtgcgtctggcataccttgaatcgccgcgtctgaaagcggttgcctgtcttggtccggtagttcataccctgttgagtgattttaagtgccagcaacaggtgccggaaatgtatcttgacgttctggccagtcgtttggggatgcatgatgcttccgatgaagcgttgcgcgtggagctgaatcgctattcattaaaagtgcaaggattgctgggacgtcgctgcccaacgccaatgttatcaggctactggaagaacgatccgttcagcccggaagaggactcacgcttaatcacctcatcatctgctgacggtaaattattagagatcccatttaacccggtgtatcggaattttgacaaaggtcttcaggaaatcaccgactggatcgaaaaacgcttgtgttaaaaatttgctaaattttgccaatttggtaaaacagttgcatcacaacaggagatagcaatgacgttaccgagtggacacccgaagagcagattgatcaaaaaatttaccgcactaggcccgtatattcgtgaaggtaagtgcaaagataatcgattctttttcgattgtctggctgtatgcgtcaacgtgaaaccggcaccggaagtgcgtgaattctggggctggtggatggagctggaagcgcaggaatcccgttttacctacagttaccagtttggtctgttcgataaagcaggcgactggaagagtgttccggtaaaagacactgaagtggttgaacgactggagcacaccctgcgtgagtttcacgagaagctgcgtgaactgctgacgacgctgaatctgaagctggaaccggcggatgattttcgtgacgagccggtgaagttaacggcgtgagtgaaatgtgccggatgcatcacatccggcaatattcattaaaactgatacgtcatgccaaccgcgacaatatcatcattattaatattcaatttgttatcgctatccagttggttgattttataatcaacaaacgctgacatatttttgttgaaataatacgtagcaccgacgtcgatataattgaccagatcttcatcaccgataccttcaatatctttccctttcgataagacataacccagcgatggacgcagaccaaagtcaaactggtattgagcgaccgcttcaaagttctgtgtcttattggcaaagccgccagttattggcgtcattttgcgtgtttcagaatagaaagttgccagataaatattattggcatcgtatttcagacctgttgcccatgcttctgcacgcttgcctgtgccacggctttgcaggttctgctcgttggtgcgatctgagttggtataggccccactaatggcgaaatcgctgccgccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggaatcgccaccaaattccgggaacatatcggtccaggcttccacgtcatacaacgcccccaggttacgaccataatcgaaagaacccaaatctttatatttcaacccggcaaaagcgagacgcgttttttgctgtgcagtatcactctctgctttattaccggcaaactctgcttcccaacgaccataaccagtcagttgatcgttaatttgtgtttcgcctttgaaaccaaaacggatataactctggtcgccatctttactggcgttatcactcatataatgcatggctttaactttgccatagacatccagtttattaccgtctttattatatatttctgcagcctgtacagatgcagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctaggcttgctgatcccgcgcaacaaaacgccatgctttgctcgcagatggttggcaaccgacgacagtcctgctaaaacgttcgtttgatatcatttttcctaaaattgaatggcagagaatcatgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgaccatcgcctcgaaacaactgctggcggcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgagcgttgctcgataacaatatcgttccggtaatcaatgagaacgatgctgtcgctacggcagagattaaggtcggcgataacgataacctttctgcgctggcggcgattcttgcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattctggaacgcggcagctccctgttgccgaaaggcattaaaagcgtgactggcaatttctcgcgtggtgaagtcatccgcatttgcaacctcgaaggccgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagcaggctgatgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgagccaatggccttagcgaagcgatgcttgaccgtctggcactgacgcccgcacggctgaaaggcattgccgacgatgtacgtcaggtgtgcaacctcgccgatccggtggggcaggtaatcgatggcggcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccattaaaatcaaattgttacgtaagatcttatcattctcccaccaaaaaattatcttaatgtaacagctggtgtaagtaaattctatcaacgaagatcaatcttatctactgaccaaaaaggcctgatagggcttcgctcactatacatccttggctgcaggtttagttgtacaccactcctaaatttaatgtgttggcaatgtgttcaataaagctcgaacaaattagctcattatgatcggttaatacttcaacttctggttgcatgattgtttgtccgtaaaaagataacgcgcctgccgggtagtagcaggcgcattacgcaataggtaaacaagggaggaagttcagaaatgtaaatcgggaaggttgtacgcaatgttcatcgtactacgttgttacggctttgccgcaacaagccagttgcctgccgcgctcgcagaatgtctgcagcccggagataaggagattgttcctgccagctaaatcccttcctgtcgatacgaaccagctcgtatttttctaccagaaaattcacggcatcggctagggtgataccggcatcgatgtgttccttaatcacagcctcattgcagaatggcgtgtcgtttattgtcagaccatagtgctgttccagcagacgtgtcagtaacatttgccagacagccacgggtgacaggcagggcttcaccgcccgctgagttattgcaggtaaagttttcatgtttgctctcgtgtaggtaattaacgctgagtggggtaaatggcgatgtatacgtagccgcaactgccaagggtgtcggcttcgcaggttaaatcgttgtggtacagggtaacgcagtgggcatggtgggggctgagttcaccggtggtcagcatcgattccatctggaggataaagtgcgggaatgtttcatccagcttccggcattcgatgtcactgaacttgccggtgatgctggcccggtcagccagataatgcagtcggttgccttcctgcaccagacgggctcccaggcgcagtgtaatctcccgctgcaggcccctggtagggttgctcattacagttctccactattgtcagttcagggtgatgctcatcaggcaggtatagggcccattgcggtcctggcggcgttcggcgtataccgcgaggactccggcgatatccggaacgtccctgccggtgtaatgacagacgctaccgtgccactggtatttgccggtgcagtagcgaaagattcgggactcaggatgctggcggtatatcgtcattgccctgcgtttactgataattttcatgtaatacctcaaagcagaccgtgttctgcgaacgaatagatttgcctgccaccgacaatcagatggtcagggacacggatatccaccagctgaagcacctgaaccagtcgctgcgtgagggttttgtcggcctggctaggtgtcgtctcgccggaaggatggttatgcgcgagtatcaccgccgccgcgttgaagtgcagagcacgtttgaccacctcccggggatgcacctcggtgcggttaatcgtgccggtgaagagcgtttcatgggcaatcaactgattctggttgtccagatacaacacccggaactcttcccgctcaagcgcggccatatgcagtcgcagccattcacgtacggcgtgggtagaggtgaaggctacgccgggctcatgcaggtggcggtccagagccctgagcgcccgctgaatgagacgccggtcctgtggcgtcatctcgccgggtaaaaaggaaagctgtttcatctgttgctccttcggtcagtcgataatacgcagaatggcgtgagcctctggatgttgcatggcatactcccgcaggcggtaatagtgtgcggtcatcgcgtcacattctgtacggcaggcatggtggctatacgcaatcaggcagacagcaatacctgctgcttctgcactcatttgggcatcgttaccgttcaggcagttaaacagacgccatgtctcatcgttgtcaggctcgggggacataaatgcgccgccattgctgagggtgtagaacgaccagataccaccgctgtagccctcacagaagcggtccatccaggcgaagatatgcggctccaggagtagccactgcgggatagcgccaaagtactgtggccagaaatcgatacgctgttcatcggggaccggcgtgacggtcagttcaaattcgggttggttagcgggtgcgaggtcgtgctgcgtctgtgttgtcatgggtatgtctccgtcaataaaaacgccagcggcgatggctggcgtatggggatataaagtgtgttcggggaggtgaatgcgggtaaatgcttcgcgatcagcgggtggccgtgtctgtacggatgcctgaggtgcggatatagcggttaagaccttcaccggcatccggctcaaagttccatgcccgccagaccatccggccttcagtatcacgaaccaccagacggaagtgactgccctggtcgtcttcgagtgtgatattgctgtacgtggtagtgaccgcttgcgcttgtctccgggtgaaaggccccggtggcagcaacacggattgggtcattttcgggctcctgataaaagaaaaccccggcagcctgctagctgtcggggtgaatttgctggggaagatactactatcagtcgttgctgcagtctccgagagtggacagaactttctcagcgttcttccggtccgcagtgaaggtccctgctttgtggtcattgacgtagacgtcgaactgcccggcctcagagatattgctgatgaagtcaaaccaggcgttatcgccgttacgccagcccaggctggacggaataatgtactgctggtgatccatcactacggtgatagtagtgtcgtcatcgtgcgaactgaccatcttgtcatcggcaagggtaagaaagactgaatgctgatagaaaccattctggtccgggttccctgtgcagttgatggtaaacgtctttccgctggcttcggtcacgctgtattccgtattgccctgaccgtaaccctgctgccagaaccccgggatagcagaggcattaaagctcgcgagcagtacacccgccagcataaaccgacttagtgaaagtattgtcattcttgtctcctttgtcgttgttttattcctgattgtcagggttcgagggtatcagtagctgccccatcagtttgccgtcatgggcgtactcaaagtatttttctttggtatacgggtccgtcacctcctggtattccagtttgatgttatcggcaatacacagcgcattcatcagtggctggacggttttttcctgcatatccacgaggtagtagtaactgccatcctcgcagccatcgggcgactggcgggtacgtaaaacctgcaaggtgggaccggataagtagtcaacctgtgaccattcttcgctgacatcatcctggtggctgaccacatcactgaaacgcggtggggtgaggtccttaaatttactgatggccttcaggtcatcacttctgtcatcgcatgcgatgagaaacagagtggtggcaaccagcgccagcagaggcagtgttttacgtttcattatttttttcctgaaatcagacgaaccactttggcaaagacataaatgcccacgaaaatacccaccggcacgccgacgaacggtgtcagcgcgacactggcagcaccggctgcgccacctcccgtcagcagtgcggcaacagtggcaagggtcagggccgcgagactgtcggacaccccggttttgttcagaatgatgacgatgacaacaatggcgataatggcaatatccggactgatactccaggtccagatacatcagccgctcacgaaaatcacgccgcagcgtgcgcaccgacacaccaaactcagcggcaagcttacgcacactcagcgtttcccctgccaccagacggctgattatcagtgacagcctgacagccagccggtcatggcggcgttctgcctgtgtcatgagacgttctccgtgaaagttaactgactgaaaatgatgtgattactttaaagagggggtcggacagggtatggacaccacagaaactatttttcatttctgcaaaagccagaggcagcgggggttacaggccttccctcggtgagtgaggaccgtcagcacggtgcgatgcggacaggtggtgtccgatattaacaaagcagcaacattaaacggtcactgcagttgcgtgagcagggcttccgccatcacccacagtgcccggttaagtttcacgtccccgtcgataccgcgaacggcacgggtatgtgaccgtcctcctttggcattacggccactgagcccgcccttaatcaggttctcctgaatacgctggtacgtggtccacaggtcattgctctcatcctgccagcggcgaggggagaggatctgcgattcagtcaccggctggtggtcttcaccaaagcggtatgtgagggcggcttttgccagtgcctgctgtgccgggggtggcaacagcaacgactgcatggcatcccgtttctcctccacccggtcaaaaatccccagcacctcatacgcgccttcaatcacctgactcaccacgtcccccttgtgtggcacccgcacctcgccaaacgactcaccgcagacgagcccgttctgacaaaccgcacgaaatagtcccggcaacatctgatacgaactggttccatcgtgagagttgagtagaataatttccggcacctgtttaccggtgatctgcccttcccgccgcagacgcagcatatgctttgtatgttcacgacgacccgggtcacgcacgcgggtctgacaggcaaagaatggctggaagccttctcgctgtaggctgtcgagcagggagatggtgggtatataggtataacgctcactacgggactcgtgtttgtcctcactgaatacactgggcactacgcgaaacagctcttcacgggttaacggacggtcgcgacggataaggtttgctgcgccaaagcgcgaagccagacgggtcataagcagactcctcataacgggaaaacaaataaaagggatccccgtcgcatcggcgacaggggcagggaagtaacagggatgggttaaatactcagaagaagaaatcccagacggcgcgggccactgacaccaccgtggtgcgcacggcctgaatgacggcccgcaccggggcgggtatcaggggaaaggcactgatgctatcgagtacggccccgacggtttcaccaaaatcgctacgagcctgttcccggactaccgtcgtgcgaaaggaaggatggagttgcgacaccaccgggctggtggcctcacgtggcaggcacttaatcatccgctcggccatcaccttaagcccccattgtagacggaccgacacagcacacaccggatggacgggctggaacagctcatgcagcaggcagattttgcggctgatattctgcttctgcgccgtggacaactgtcccccaccgctggtaggttcggccttatccgactggctgataacaaacagcaccttatgccggtatacctctccaatcacctgatgataaaaatgttcatccaccgtcagcgcccggtcatcggccttaatcagccacagtaccaggtcgaggcgaggaagctgttcgcggtacagcgcagcatactcggtatcgcgagcgccactttcgcccacgccgggcagatccatcagcgttatatagcggtcgccgacttgcaggcgaaagcgcagtggctcacgtgtacaggccgccacatcgctgaccggtgatatatctccggcaaacagggcattgcacagactgctcttcccaacaccggttttacccataatgccgatcactggctcgtagttagttaactggttaatttgctgcagaagccgctctgatacccattgcggcagatcagcaagcgattgctgaaacgacttcaaaccttcagaattattcatcactactcctctgaaaaataataaaaaacggtagaatcgtgagattccgccgttaattgcgtatgttcagagtgatgatatatatctgaagattttttcaatcctctgcgcttgaggcagctgcgcgactgctggctcaggcaatgaatgagttataatagcagcatttactaacagggatttattgagagtatgagccgccgtgatacaccttaaaatctcaacccagcaaagtttcggagccgcgagcaaaagtgagagccttcacaaaataatgcttagtaataaagttactttgaattcagagccccgattaatgtgaacatgatcaacgaattttacccagattgagttcattcagtagccaggttttgaacacatcaagcgcagaatgcatgtgttggtgctgggggaaaaccaaataatgaccgatgtaatgtatttcgctggtactgtttacaagtgggcataccagtttaccgctagcgatttcacgttcagccagtagttttgattcaagcacaactcccaagccgtcaactgcggcagcaatcgccataaagctacggtcaaatcgaaggccataattattgggtggcgtcatcttattcgcctcaaaccatcctttccactggtacaactgcacatcgcactgaatcaatgtcaacgcatagagatcctctggtttctttagccgctcagccagttggggagaacacagtggcgtaagttcttcaacagcaagcgggatcttctcatagggtgatgggcggggttcaccgtagactatatcgagatcaaaatcatcctgttcaaaacgtgcatattctgtgctggctgaaagtcgcagatcgatgcttgggttctcacgtatgaacttaccaagacgtggtaaaagccattgatgggcaaaactcggtgcagtatgaaggcgcaaaggcctggattcatcagccgtcactaatgccaacccctgctgtaattcgttaaatccccgctgtatgtgctcaagcagtatttcaccttctttcgtcagcgtaatttctcgcgtactgcgctgaaaaaggcgtacatcaagcaagttttccagtttgcggatggcatggctgatcgcactgggtgacagttccaactcagaggcggccaacgcaaaagctccggtacgaccagccgcttcaaaggcgcgtaacagatttagaggtgcttttgctaagagcttcattcatgaatccttttcactagggatgaagtggtttactgaatttggccacctgaacagaggtgatatgctcacctcagaacaacacaggtgtcataatgaaaaaaagaaatttcagcgcagagtttaaacgcgaatccgctcaactggtcgttgaccagaactacaccgtggcagatgcagccagcgctatggatgtcggcctttccacaatgacgcgatgggtgaaacaattacgtgatgaacggcagggcaaaacaccaaaagcctcccccattaccccggaacaaattgaaatccgtgagctcaggaaaaagctacaacgtattgaaatggaaaatgaaatattaaaaaaggctactgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctggggcattgggagggcgatttagtctcaggtacaaaaaactctcatatagccacacttgtagaccgaaaatcacgttatacgatcatcgttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaatacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacaaccgcgctcttgatgtcagactccctgaacagttctcgataatcgggaaactcagggcgcgttatcctgtggccactctctgccatgtgttcggggttcatcgcagcagctacaaatactggaaaaaccgtcctgaaaagccagacggcagacgggctgtattacgcagtcaggtacttgaactgcatggcatcagccacggctctgccggagcaagaagcatcgccacaatggcaacccagagaggataccagatggggcgctggcttgctggcagactcatgaaagagctggggctggtcagttgccagcagccgactcaccggtataagcgtggcggtcatgagcacgttgctatcccgaatcatcttgagcgacagttcgccgtaacggaaccaaatcaggtgtggtgcggtgatgtgacctatagtgtgcccggagttcagggcgggcatggatgcttaaatgaaccgcgagtctgtctggaatattgaaccggtaactcacgatgagaaacccaacaatcccaccgggtgtgacggtggagaacctgagcggcagtgacctgcggcatgcccgcagggtgatgtaacccgctgacaacggggattgaggcgagatcactaagccgagatgatcctcaaggttaagtactgaaaggttgaagaacatgaacccgttaatccgcctctgtgggttgaaaacgtcaccacggcctacgtgatctgacaggccgtgcaggaggaactggcagtgatacgtaagcactgccggtcgaaggtgttttgacatgtatgcgaaacaccggggcagcagcgtctatcacgcttgcgttgctgacttctgccaacttgcggcaagcaaggataaagagtgcgacgggcagcctcctcagtatgcctgagtccaggcaggtaaaccggggaaggtcagcgacggatgttaagggggcatggctccgatgacgcgctggctggcggagcttccgtagtagtccgcgatggggaaagcccattacatggcgaagggaagcagtttgaatgtgtttgcgacgtgaattaactgacctaacgaggtgaagacctttgataatcagcgaaatgcaacgcaagcttgccacatgggcagccaccgatccgtccctacggattcaacggctgctgcgtctgataacacaaccagaatggctggctgaagcggcgcggatcacgctttcatcaaagggggcccatacccccggcgttgatggcgtgaacaaaacaatgctacaggccagactggctgttgagctgcaaatcctcagggatgaattactctcaggccactaccagcccttgcccgccagacgggtttacatccctaaaagcaacggcaaactgcgaccactgggtatccccgcgttgcgggatcgtattgttcagcgggccatgctgatggcgatggagccgatatgggagagtgattttcatacgctctcatatggcttccggcctgagcgcagtgtccaccacgcgatccgcacggtgaaattacagctcacagactgtggtgaaacccggggacgctgggtgattgaaggcgacctgtccagttacttcgacaccgtacatcatcgactgctgatgaaggctgtacgccgcaggatcagtgacgcacgtttcatgactctgctgtggaaaaccatcaaggcgggacatatcgatgtcggtctctttcgggcggccagtgaaggtgtgccacagggcggtgttatatcgccgctattatcgaacatcatgctgaatgagttcgatcaatacctgcatgagcgctacctgagcgggaaagccagaaaagatcggtggtactggaataacagtatccaacggggccgaagtacggcggtcagagaaaactggcagtggaaacccgcggtggcgtactgccgctatgccgatgattttgtcctcatcgtcaaaggcaccaaagcacaggtggaagccatcagggaggagtgtcggggtgtgctcgaaggcagtctgaaactcaggctgaacatggataagactaaaatcccccatgttaatgacggctttatctttctggggcacaggctcattcgcaaacgcagtcgttatggcgagatgcgagtggtctcaacgatcccgcaggagaaagccagaaacttcgccgcatcgctgacagcactgttatggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccggaggcgttatgagctggcggccctttttgtatctgattattaatccccacccgctattaagcgcccggcgcgggcatctgcgtctggtgcagggttgactttgcattctgttaacaaacgcggtataacaaaccttctttggatgtttagatgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcgcatcaggcattgccggatggcggcacaagcgccttatccggcctacaaaaccacaaaacgttatgccgcatccgccagaacaaacatgccgtacggatggatttcaagataatactgctcgccgacgtccggttgcagacgcgtagcgttgacctgcaataatatctcctgcccgtgccattccaccgtcacttcatactgcggccccatataggcgacatggcggatcacgcagcgctggctctcttcgccgcgatcgctgagcgtgatcgcttccgggcgcacaccgaccatcccttcaccctgtgtaccaaagtgcagcgggcgcggcagatgatagccgtagatatcaacgtatccgtcgctgaaggttgccgggaacaggttggcatcgcccataaagctcgccataaagcgggaggcgggctggcggtaaagatcctgcggtgagccgatctgcatgatgtgtcccttgttcatcaccagcacagtatcagaaaccgcaaaggcttcgctctgatcgtgggtgacgtacagcgaggtgatatcaaactgcttttgcaactcgcggatcttgtcgcgcatgctgcgacgcaggttggcgtcgaggttactcaacggctcatcaaacagcagcactttcggcttgaggatcagcgcgcgggccagcgccacgcgctgctgctgcccgccggagatctgatcgacaaagcggtcttcgaatccttccagatccaccatcgccaacgcctctttgacgcgggctttcagctctgcgcgcggtacgccgagcattttcaggccataaccgacattctctcccagcgacatatgcgggaacagggcataggactgaaacaccatacagatatcgcgctgctgaatagagcgatgggtgacgtcttcgccatcaatgaaaatttgcccttcgctcggtttttccagcccggcaaccaggcgcaaaatagtggttttgccgcagccggacgggccgagcagcgtcaccatttgcccctgcgggatggtgaggttgatattgtcgattaccgtattactgccaaatcgtttagtgacgttgcgcagttcaacgaaatttttctgagtcatagtgcgctccattacgcctggtttttggcttttgaacgggaggtacgtgattcaccgatcagccagtcaaagatgaaaataatcgccagcatcaccacgatcagaatggaaccgtaggcaatcgctacaccgtattcgccatcttccacgcggttgaggatgtaagccgtcgctacgcgggtatccggcgtgacgaggaacacaatggcgctgacggtggtaatggcgcgcacaaagctgtaaatcagcgccgagaggatcgccgggcgcagcagcggcagcaggatgtgcgtaatggtacgcagggaaccggcgcgcaggctgagtgaggcttcatcgagcgatttatcgatttggcccggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacagcagctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgagatcaacaacctgtttgactgcttcagttttaaactcttcgggataacgcttaccgctcatgggcacctctctttaagccattttaaatgactcggaggtgtctgttaaacccgtggcgattcaaaattgcgatatatacatacccatgactgcccagcgtatcggcttcaccagtcagcccgttacggtacagtgtgacacagtgcgcgtacctgggattcagctcacaggagagcagcatcagctccagatgtgcgacaaaatgcgggaaggcttcatccagttgtagagtctgcacctcactgaatgagccggtgaatccagcccggtcagccagaaaatgcagacgatgaccttcctgcaccagtcgtgctccgaaacacggtgtgatatctcgtttaagcccccaagtttgagtagagtctttattcataattttattcctgttaaagaagaccatgttcggcgaatgagaatatttgcctgccgccgacaatcaggtggtcggggacatggtgaacactttttaacatcctttacccatggtgatcgactttttcttcaggtcgatcacccccactttcgtgctgtaccaccacacctcgtagctgccgtcttcctgcatctccttcagcccgacccgttctcccctgaacgccttgcctgcgctcagacttacccctttcacgctcagctttccgctgatatccactttcctgaccatcaccccttcatcgtattccgggggcgttgtgttgccgctgtactgccgcgctgacggctgataccgcgagcccggtaccgccatatccagcgcctcgtgcgggcgttcaaggttatagaccgtccgccagtggtcgaaggcgcgctgcagttcaccgctgtctgcgaaccattttccctgcagcacttccgccttcaggctgcggtgaaaacgctccagcttcccctgcgtctgcggatgataaggccgggagtgccccacccggatacccaggcgcatcagccacagctccagcgccgtccaggtgccggtggtgtcgccccacggtgagccgttatccatggtcatccggtccggcaggccgtaacgctcaaacacgctgaccagctgctgctgcacggtctcgcgccgttcatcggtacagtgcgccaggcacagggaaaaacgggagtggtcgtccagcagggtgagcggatggcagcgtccaccgccaaaaggaaagtggcccttaaaatccatctgccagaggcggttcggcgcgtcgtgttcgaaccggcccgtggcgggaatgcccggtgaagcgcccggcagcaggccatggcgggccatcaggttatggacggtgctgaaggcgggcatggtgtgcccctggtcctcgagccagcgcttaatcttgcgggctccccagcgttcatgacggtcatgggccatacgcagcagggccgtgatgtcgtcagatgagcggttcggggaatggtgcggaatgcgcgggcggtcctgaagaccggcggcaccttcctgagcccagcgctggagccacttgtagccggtggcaggtgaaatgccgaagcgacggcagagggaacggatgttcgccccgtcctgcgaggcgaacaaaacaaactcagtacgtaatgacatggtatctctcgcatcccagggcataagcgactccataaacgggttcttatgccttagttgtaagtgtctaccatgtccccgaacaagtgttcactatgtccccggaccgtacaccccaaaggggagaggggactgcaccgagccatcttttccccctcgcccctttggggagagggccggggtgaggggcaatatgtgatccagcttaaatttcccgcactccctcttcccttccgatttacctctccttgttctgcgtcatagtatgatcgttaaataaacgaacgctgttctataatgtagaacaaaatgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctgagccggacgataacgatgaccattgagaaaattttcaccccgcaggacgacgcgttttatgcggtgatcacccacgcggcggggccgcagggcgctctgccgctgaccccgcagatgctgatggaatctcccagcggcaacctgttcggcatgacgcagaacgccgggatgggctgggacgccaacaagctcaccggcaaagaggtgctgattatcggcactcagggcggcatccgcgccggagacggacgcccaatcgcgctgggctaccacaccgggcattgggagatcggcatgcagatgcaggcggcggcgaaggagatcacccgcaatggcgggatcccgttcgcggccttcgtcagcgatccgtgcgacgggcgctcgcagggcacgcacggtatgttcgattccctgccgtaccgcaacgacgcggcgatcgtgtttcgccgcctgatccgctccctgccgacgcggcgggcggtgatcggcgtagcgacctgcgataaagggctgcccgccaccatgattgcgctggccgcgatgcacgacctgccgactattctggtgccgggcggggcgacgctgccgccgaccgtcggggaagacgcgggcaaggtgcagaccatcggcgcgcgtttcgccaaccacgaactctccctgcaggaggccgccgaactgggctgtcgcgcctgcgcctcgccgggcggcgggtgtcagttcctcggcacggcgggcacctcgcaggtggtcgcggaggcgctgggtctggcgctgccgcactccgcgctggcgccgtccgggcaggcggtgtggctggagatcgcccgccagtcggcgcgcgcggtcagcgagctggatagccgcggcatcaccacgcgggatatcctctccgataaagccatcgaaaacgcgatggtgatccacgcggcgttcggcggctccaccaatttactgctgcacattccggccatcgcccacgcggcgggctgcacgatcccggacgttgagcactggacgcgcatcaaccgtaaagtgccgcgtctggtgagcgtgctgcccaacggcccggactatcacccgaccgtgcgcgccttcctcgcgggcggcgtgccggaggtgatgctccacctgcgcgacctcggcctgctgcatctggacgccatgaccgtgaccggccagacggtgggcgagaaccttgaatggtggcaggcgtccgagcgccgggcgcgcttccgccagtgcctgcgcgagcaggacggcgtagagccggatgacgtgatcctgccgccggagaaggcaaaagcgaaagggctgacctcgacggtctgcttcccgacgggcaacatcgctccggaaggttcggtgatcaaggccacggcgatcgacccgtcggtggtgggcgaagatggcgtataccaccacaccggccgggtgcgggtgtttgtctcggaagcgcaggcgatcaaggcgatcaagcgggaagagattgtgcagggcgatatcatggtggtgatcggcggcgggccgtccggcaccggcatggaagagacctaccagctcacctccgcgctaaagcatatctcgtggggcaagacggtgtcgctcatcaccgatgcgcgcttctcgggcgtgtcgacgggcgcctgcttcggccacgtgtcgccggaggcgctggcgggcgggccgattggcaagctgcgcgataacgacatcatcgagattgccgtggatcgtctgacgttaactggcagcgtgaacttcatcggcaccgcggacaacccgctgacgccggaagagggcgcgcgcgagctggcgcggcggcagacgcacccggacctgcacgcccacgactttttgccggacgacacccggctgtgggcggcactgcagtcggtgagcggcggcacctggaaaggctgtatttatgacaccgataaaattatcgaggtaattaacgccggtaaaaaagcgctcggaatttaattattttaagagataaaaccgtctgcggaatatttcccgcagacggctttgttgtttttgaaatttattaatttaaacaattagttgagatatatcgttggcgtcacaaaagcaaaataacgtaattcggaaataagatatgaccattgctggttaattgaatagctcattacactccattaacacgatgttgtaattcggcacactacataagggtgtaattctgatgacgcaattaaccatgaaagacaaaattggctacgggctgggagacaccgcctgcggcttcgtctggcaggccacgatgttcctgctggcctatttctacaccgacgtcttcggcctgtcggcggggattatgggcacgctgtttttggtctcccgcgtgctcgacgccgtcaccgacccgctgatggggctgctggtagaccgcacccgcacgcggcacggccagttccgcccgttcctgctgtggggggccatcccgttcggcatcgtctgcgtgctgaccttctacacgccggacttctccgcacagggcaagatcatctacgcctgcgtgacctacattctcctgaccctggtctacaccttcgttaacgtgccgtactgcgccatgccgggcgtcatcaccgccgacccgaaagagcgtcacgccctgcagtcctggcgcttcttcctggcggcggcgggctcgctcgctatcagcggcatcgcgctgccgctggtgagcatcatcggcaaaggggacgagcaggtgggctacttcggcgccatgtgcgtgctggggctgagcggcgtggtgctgctctacgtctgcttcttcacgaccaaagagcgctacacctttgaggtgcagccgggctcgtcggtggcgaaagaccttaagctgctgctgggcaacagccagtggcgcatcatgtgcgcgttcaagatgatggcgacctgctccaacgtggtgcgcggcggggcgacgctctacttcgtgaaatacgtgatggatcacccggagttggcgacccagtttttactttacggcagcctcgccaccatgttcggctcgctttgctcctcacgcctgctgggccgcttcgaccgcgtcaccgccttcaagtggatcatcgtcgcctactcgctgatcagcctgctgattttcgtcaccccggcggagcacatcgcgctcatttttgccctcaacatcctgttcctgttcgtctttaataccaccacgccgctgcagtggctgatggcttctgacgtggtggactacgaggagagccgcagcggtcgccgcctcgacgggctggtgttctccacctacctgttcagcctgaagattggcctggcgattggcggggcggtggtgggctggatcctggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagccgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaccgcgccctccatcgaggggccatggagcgagccaatcccgatgggcaacggcgggtttgacccgtccctgttccacgacgacgatggccgcaaatactatatctaccgcccgtgggggccgcgccaccacagcaacccgcacaacaccatcgtgttacaggcgtttgacccgcagaccggcacgctctcgcccgagcgcaaaacgctgtttaccggcacgccgctctgctacaccgaaggcgcgcacctgtatcgccacgcgggatggtactacctgatggccgccgagggcggcaccagctacgagcacgccgtcgtggtgctgcgttccaaaaatatcgacgggccgtacgagctgcacccggacgtaacgatgatgaccagctggcacctgccggagaacccgctgcagaagagcggccacggctcgctgctgcagacgcatacgggtgaatggtacatggcctacctcaccagccgcccgctgcgcctgcccggcgtgccgctgctggcctccggcggacgcggctactgcccgctggggcgcgagaccggcatcgcccgcattgaatggcgcgacggctggccgtacgtggaaggcggcaagcacgcgcagctgaccgtgaaaggcccgcaagtagccgagcagcctgcagccgttccgggcaactggcgggacgatttcgacgccagttcgcttgacccggagctgcagaccctgcgcattccgttcgacgacaccctcggctcgctcaccgcgcgcccgggcttcttacggctctatggcaacgactcgctcaattcgaccttcacccaatcgaccgtggcgcgccgctggcagcacttcgccttccgggcagaaacgcggatggagttctcgccggtgcacttccagcagagcgcggggctgacctgctactacaacagcaaaaactggagctactgctttgtggactacgaggagggacagggtagaaccatcaaagttatccagctcgaccacaacgtgccgtcgtggccgctgcacgagcagcccattccggtgccggaacatgcggagagcgtctggctgcgggtggacgtggatacgctggtctaccgctacagctactcgtttgatggcgagacgtggcacaccgtgccggtgacgtatgaggcgtggaagctgtcggacgactacatcggcgggcgcggcttcttcaccggcgcgtttgtgggcctgcactgcgaggacatcagcggcgacggctgctacgcggacttcgactacttcacctacgagccggtctaacggctcaggccgggtagcccagcgcgcgcgagagcgcgagcccggcctgctgaagctgctcgcggaaattagccagctccgcgtcgtccacgcgggaggtcagcgtcgacaggctcagggcggcgatgacgcgggactcgtggttccacaccggcaccgccacgcagcgcacgccctgctcgttctcttcgctgtccagggcgtagccttgctcgcgggtctgcgccagggcgctcattaaggcttcgcgagacgcgagggtggcgggcgtaaaggtagtgtactgatagccctccagcagggcgttcagctcggcctcgcccagccaggcaatcaacaccttgccgatggcggtggcgtgcaccggcaggcggcggccgatgcgtgaataggcgatggcggccagcttgccttcaatcttctcgatatagaccccttcacgcccgtccaggatccccagatgggtggtctgcccggtccgccgggacagctccgtcagccagccttttgccttctgccgaatatcgatggagcccacgacaaaatggccgcgctcgaccagcttcatgccgaggcgatacttgccgttctccgggttctgatcgatatagccgtgaagctgcagggtttttagcagcgagtggagggtactcttgctcagccccatcagtttgctgatgtcggtgatcttaagctcggtggcctgctcgttgaacaggtcgaggatctgcaacgcacgttcaacagactgaataatcggcataatgctggcatgtccacgctggaattaaggcgaaaacgtacctttttcgggatgaaaaatcaatgaaatggagccggtgttctccctctccctgtgggagagggccggggtgagggcaccaacgcgcagcggacccaatcactccccaagcgttgccatcatcaccgccttaatcgtatgcatccggttttccgcctggtcgaacacgatgctcgccgccgactcaaacacctcgtccgtcacctccatcccgccgtgcagatcgaactccttcgccatctgcttgccgagcgtagtctggtcgtcatggaacgccggcagacagtgcaggaacttcacgttcgggttgtcggtcagcgccatcatctgcgcgttcacctgatacccgcgcagcagcgcaatccgctctgcccacttctctttggcctcgcccatcgacacccacacgtcggtatagataaagtccgcgcccttaacgcctgccgccacgtcttccgtcagagtaattttcccgccgtgcttctccgccagcgcgctgcactccgccaccaggctctcttccggccagcaggctttcggggccaacaggcgcagatccagcccggtcagcgccgccgcttccagcatcgagttgcccatgttgttgcgcgcatcgcccgcgtagaccagcgtcatctcgttaaacgccttgcccggcaggtgctcctgcatggtcatcaggtccgccagcagctgggtcgggtggaactcgttggtcagcccgttccacaccggcacgcccgcatactgcgccagcgtttcgaccacttcctggccgtgaccgcgatactgaatgccgtcatacatccgcccgagaacccgcgcggtgtccttaattgactctttatgcccaatctggctgccgctcggccctaaataggtaacgcgcgcgccctggtcaaatgcggcaacttcgaaagagcaacgggtacgagtcgagtctttttcgaagatgagcgcgatgtttttaccggtaagcttctgtacttccttgccattttttttatcggctttgagctgtgcggcaagggtcagcagagaagtgaactgtgcaggggtaaagtcgagcagtttcagaaagtgttttttgtataaatcggacattttatcctcgcatggcgaacgccacttattgaattaaaattcactttatatgtgtaattattcatttgcaaccccatttcacaattctttcttacaaaggtggaggcaaacccgtccgtgtgtgaaaataatcgtatctgcctccgattctctgcagaagcagaaagacattggatcgaattctacaaccaggtcgagtcagaaatgagaatgattggccttctttatgattttaaggattatgcttctaaaatggcggagaacatggcgaggcttgctgccttacttcattacttcagcggtgatggaggcgatatatctgttaccgggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacgtatccccactgttcgtccatttccgcgcagacgatgacgtcactgcccggctgtatgcgcgaggttaccgactgcggcctgagttttttaaatggcggaaaatcgtgttgaggccaacgcccataatgcgggcggttgcccggcatccaacgccattcatggccatatcaatgattttctggtgcgtaccgggttgagaagcggtgtaagtgaactgcagttgccatgttttacggcagtgagagcagagatagcgctgatgtccggcagtgcttttgccgttacgcaccaccccgtcagtagctgaacaggagggacagctgatagaaacagaagccactggagcacctcaaaaacaccatcatacactaaatcagtaagttggcagcatcaccgaattttcagcccggatgtttcacgtacctatgtcgaatatctggccgataaggttgcggatcgagaagaggatgcagaggaatatctggaagcaatcatggaggctcgtgttaccgttgctggcatggggctggtgatggaggtgcaggattacttcgatggcgaggccgatagactggcgaaggcgtggctggccgagtacacaccgcaaatcaagtcgttgaaagatgagcgtaaagaggcctatcgtcaaatcgtcgaaatgagtaccgaaccgcaggatgtggatctggtcaggccggcgaacaagtttgaaatgaccagggtgcgtgaaggtgaaaaggaagctgaccttccagtctggaaacaccatttgttgtgtgacgaaagcgggaactatccggctctgttgaaccattgggaaaccaaggtttttgagatcgaaaccaaacgtgaaggatttgctttctggtatcgtaatccacagtacacagggcagtcgtcactgggaatcgcttatgttgaagctgaacagtacaagattgttcgtcccgatttcctgttctttgccgaacaggatggcaaaatggttgtggacctggtagatccacatagcctacatctggctgatgctttgcccaaactggaaggacttgcgctatatgccgaacatcattctgatgcttacaggcgaatcgaatctgtcgccgaagtaaagggtaaattacgagtgttagatttgaaacggcaggatgtgcaggatgctgttgctaccgctgaaaatgcagaaacgttatttagtagcggacttgctgatgactatcagtaatctatagaaaattgcgtaacgaaactgcattttagtaattttttgaaacaatacaaataaggccttctcactgagaaggccattaccgacttacagttcgatttggctacagccgaagttacggtctccttcaccaaacactttgctttcaactttggtcaggtagtccagtcgggttaacagcgcctggtagttctgctggaagtcagtactattggtgtctagcacatacttacagttttcaggaaaatggaccagaccagggtgatcgtctctctccagtctcagggcgctgtaccaggctcctgtgatcatccctctaaggttatcgtcctgatcgtaatccccgaggtggtagtaagcgtctttgttgaacaacaggcaaatgtgatagtggcatttacctgattcagaatactctttcgcccatataataaataaagggcaacggtaaatgcgtttatcctcacgcaccttacgggtacggtcagcctccagcttagctctgagggattcacgcatccgggatatcaccccaggttccaggttagggaagcaacagatattgtcaccgttatcaactattttgggatagtggagatcgacacgtacagcaattaacctaggataccggttagtcaaataacataataatttattaatcttactctgatattcgaggatatgtactccatgagtaccttgatatgttttcataatatatacctgtatttggtcctacggtctatagcagaccgtacagggatgccatacaggcagggctattcctggtcactgttgtcggtatatactggtatcagattttagtacggacatactgatctgattactactcttactggtgaatacaggtagtaagagtacacaatgccattatataatacctatccaacatctaaatttgagacgaaggtagccccagcctgtgatggctgttaaaaagttactctgcaattagcttctggaattaaccgatgattccgttattccagtgccgcttcacagtcgataaactgatactcaatttctttgcaatctcagcctgagtaaatccacctttcttaagtattgtgatatcacgtcggtatttgcttccctcctttcgtcctaattttttcttaacatgtcgatatcggcttttagttgatttcagattgtgaatgtcaatcgtatcctgacgagcaatcaaaaaagacaagcaactttcagcagaaggctctatccttgaagctggatggtagctgtagataaacatttctttttgaaggcaaaaaaataaaatattctgtaagtcctccacagttctgccaagacagcttagatctggaatgacaagcgtgtcctgccggttcatttcatgatgaatcaattgtctgagtaaacgttgctctgaaacaacctctttaatatctacctgctcgatcacaacatgttcaggtagaatattaaatttttggcatatctcagcaagtgagtgatgatctgtaatgctttcttgctgttcgctactgcatatggtgtaaaaaaatgaacgcatctgatgcactccggtgtcataaattattttttgatacctgaataatgtcattttgcataaaaaacaaccaaaaatagagagtgattgccagcgatactttaactggtaaagtagtattttacctctcataattgtttgtccttctttgttacctcttaggttctgctctcttgtgagtatgggtttataatgatgtcatccggtacattaacacggttggaaacatctgttttgcggagcactggcagcataaccaccatttcattgacatggtaaatatcaatccaacaaacaaccggataaggcataacaatcccctttcttctaagaacttcatttatcccgaatataatcaattgggatgttgacaagagtagagcctgcccggcatcaaagtaataaccctcaaaggttgttctatgaataagaataatgtttgaatatcctgagacactttgatgctttacatcaaaatgtctttgattgtaaatgtaaatggctttttccatatcgtaattttcccttagcgaggatagcctttcacgtataactgttttttcatctttccccatgaattcatcattagcgttcagttgaaagtaatctgcaatggggatttttaatggactcatgatgttcgttttccagattaacgaacagtactcttccagagttacttctgttttacctcggcttcgattgatgctttcttttatagagaactttaacaggtcattttttatttcatttattgaccagttatgacgattgcatttttctaatatagggatagccaaatccacaacttccgctattacggaagagtgagatttatttgttagtctggcataatgatcaattactcctaatgaagattgatttttgaacgtgactgagtgtttttttatgggagtagtctgtactacctgtgactcattgtttttgccttgacaaggtttttttcctggtagaacgctgctcatctcaaaattagtaacactattagacatttttaaggaaacctctttgttatctcaatataaaactactatctgaaatttctcagtgttgccccatttttctcggggcaacatcgctataaatcaataaaattaaatctgtaatttattacagactttctcgtacagaaaatgtatctataaaatcgaggacatctttacgtaaccagtaatggcggccattgatttgttttgggcgaggtagcccctcaggcaatttgtcctgacaaagccatttacgaatggtttgagatttgtagctaatgattttagctaactcagctgttgaaatgagctgtgattgagatgtatccgggagtttgaatgcgctcattttgccacctcagtgattgagatattggcaaagaaagctttaagcattattgaattagtaggggtagtaatgaaggcagaaggaaacgtttcgggctcggggtcggggtcactaccatcacctgaatctgatgataaggcacttttagctgatttagccgtactgtgatgcgatctggatgcctgatttttacatgacatcagacgcgcgagaaagttagtagcattttgcattctttgtttaagatgtaaaattttcagtttggcgcatgcgacagacttgcgaagagctgagtatgttcctttgagatactcgacaacctcttccatggacgcaggatcgttaaaggattgagttgttttacttgaattaatacaccagcgagctctgatagctgccagagtgggttctatggatacagttgctggggttgccattggcttatctcctgtgtagttgctgtatcattgactaaactgtgtattacgatacatgaaaatctatcttgatcaatagttgatgatattttgtaatatgttgatttttaatggaatcaacgcatatcaacgttgttttttatggtaatacctgcttcatttaagatccatgtctcaattttctcgtgccattttcgtaacagatctaacggacgacggcgatagtgtttttcggcaagagcgctgggtttgtgtcccataatttgagcaacaataccagtgggaacttcaacccactcggccaaagtaccaaaactacgacgtaaaccgtgaaggctgatatgtggtaactcagccagcactaatgctctgttgtgcgctgaacgcggctcaataattttgccacttttactgttacttctgaaaacccaaccctccttatttacgtcagaatttggggattgcgctagtacatttaacaattcagaaacataaggagtgagagggatgatacgttcaccttcgatcttgtctttaattcgcatgcttgaccatttgaaatctacgtctgaccagcgaagcgacgcaatttcttcacgccgagcaccagtgagcaaaagtacttggagataggccgatgcaataggattattgaggctacgcacggcactaaaccagctttttagttgttccttttgcaggcaatcatcagctttactcgctgacacgggaaccatttttcttacgttgtaatcttgtgccagatcgccaggaatgatcccttgatattttttctgataattactccatttgatgaaagcacgtagtaggcgataagcgtgagcagtgacggtaggtctattttgcctttctgtactcagccacgctgctatgtaatctggggttagctccgataacggcaggttgagcaaactagccaatggtccagccgaagtcgggccttggcctctttttttactttcgcctccacgactggacaagttaatgtgatcggcaatgtatcgagtagaatatgggcgtttagtttttgcactgataccggttctcaattcttgaagatagtcttcccaggcgacggagaaagtcacttttgttttacgtgattctgcctgcagggattctgcttctgcgatttttacagccttagcaattcgtggatctatccctgtatcgatcaatgtttgtaaccgtcttgcctcggctctcgcatcatcaatcttccagtcgttaatgttgccaatagtcatgcgaagggttttccccgcatatacgctttggaatacaaaggcttttgctccgctagttgctcggcatgccagggttgttacatctgcatcccaaagaaaagtttgttttttcccttccggtaaggtgaatctgcgaagtctttcgaaggtaaatttttgtcttgaaagcgccatttttcggctccagttgagaattgctgtcttacaataatgtaactgctggtgtaagtaaatggagggaataaacatcaacttttgttaatttcaatcaacgggtttattgctataacttggtgttttataatataaagtatgttgttttgattgattgctcaagtagttaaaaatgcattaacatcgcattcgtaatgcgaaggtcgtaggttcgactcctattatcggcaccattaaaatcaaagagttaccccatatttaaatacaccacgtttcctcctgtgccgtatttgtgccattgtaaccttggcaattcatcaaaatactgttctgacatcaggcagtgcaggtgcagacatttaagccaattgctgccgccattctttgacgtagtcaatcagggcgcggagctttggtgcaatattgcgacgctgtgggaaatacagatagaagcccggaaattgtggaagaaagtcatcaagcagcgatacaagcttaccgctttcaatatatggcctgaaagtttcctgagtggcaattgttattcctccgccggcaagagccagcctcaacatcagacgcagatcattagtcgtaatctgcggttcaatcgcaaggtcgaaagttctcccgttttcttcaaatggccagcgataaggcgcaacctccggggactgacgccagccgatacacttatgggtatttcccccggaggcgagaaagcactctccacgcccggccgcaaggatcaggacgacgggggcaggcatgaatcctcctcctgatggagacgtacagaggcgacttctgccagcacggagagtgccagagtatgcgcatcccgggctttggggaatatcccgacgggtgcccggatttgcgttgtttcctccctggaccatcccagctcgtggagcttttgcagacgtaacgtgtgggttcgatagctgcccaatgcgccgagataaaagggttttgcttctcgcgcggcctgcaacactggcagctcccggttgagatcatggcacagcaaaatgaccgccgtatcggtatcgatctgagcgctggctgaggccggaaaaagatcgaagatatggctgtcatagcctgtggctgctgcaagactcgcggttgcctgcgcctcaagagaacgtccgtaaatcatcagcctgacgcatggcctgaaccccacctcaaagccattgagattccagcccgtccgggtttgcgtgggcaggcacaccagcgattgtgcttgcggatcgtagcgcagccccaccggttttctctgttccaggcggttcagcacggcgagcagaggctgtgccgagcgtagtttatggagcgtcagcgtgatcccaccgccgcagggcagaacgatgtcaaaccacggcgaaccttcgccatagcgaatttcgcgatcgcggcctgagcccatcatctccagcgcttcaaaagcggcagcggcctccacgcagccgccagagacaaaaccgcagtaacgaccatcttcgcgcaccaccatctgcgccccgagcgggcgcgccgcgccgccgcgtatctccaccagcgtcaccagcaccgctcctttaccggacattagcgcctctacggcgaagcgcagaatggtccggtggtcatcggtgagaaacgcctgctctggcttatgccagtgttcgtctttgtcaaaaagcgggtatgacattgttcctccttaaaccacatccggcagcttatcgagcagcttatccagagtgatgggataatcccgtacccgaataccggtggcgttatacaccgcgttggcgatagccgcgctcacgccgcacaggcccagctcaccgacacctttggccttcatcggggaggatatggggtcggtatcatccaggaaaatcacctcctgttttgggatatccgcatgaaccggcacctcataccccgccatatcgtgattaacgaagtagcccaaacggtcatccaccgccagctcctccatcagtgccgcgcccatgcccatagtcattgcgccaatgacctggctgcgcgcagttttcggattcaggatgcgtcctgcagcacacacagcgagcatacgccggacccgaacttctcccgtcgcgctatgcacgccgacctccacaaaatgcccggcaaaggtcgactgctggtactctttgctcagtgttccgaattcaatgctctcttccgctgtcagtctgccgcctgcggtggcttcatgtagcgtggcgcttcgggtaccgttggtaatcttgccgtcggcaaactgcgactgctcaggatcaaacccgactgccgaggcaatcatttcgcgaagcttcatacaggcggcgtaaacgccggaggtggaggtattcgcgccccattgtccaccagaacccgcagaaaccgggaaactggaatcgccgaggtgaaccgcaacctgctccagcggtacgccaagcatttccgctgccgtctgggccagaatggtgtagctgccggtgccaatgtcggtcatgtccgtttctacggtaacggtgccgttttgttcgaggtgaacccgagcacccgatttttccagcagattattgcgaaagcccgccgcaacaccgtggccgactagccactccccgtcgcgcacctgtccgggtgtggcgttgcgctgcttccagccaaatttatccgctccggtgcgcaagcactcgataagctgacggcgagagaagcagcgcgtcgggtcggcggggtcaacctgagtgtcattcaggatgcgaaactcgacgggatcgatgcccgctttttccgccagttcgtcgatcgcgatttcgagcgccatcagaccgggggcttcgccgggcgcacgcatggcgttcccttccggcaaatcaagcgtggcgagccgcaggccggtatgacgattcgccccggcgtagagtaattcgctttgctgtaccgccgtttccggcgtgccgccgggcaggtttccagaccagctttcatgtgagatagcggtgattttcccgctctggtcggcaccgatacgcaagtgctgaagggtggcggggcggtgcgtggtgttattgggaatagaggggcgggggagcatcactttaaccggacgtttcaccgctcgggcggcgagggccgccagcagcgcatcgcttctcaggaacagcttgccgccaaaccctccgccgatatacggggagataatacgcacattctccacgggaactttcagcgtttttgccagatcggtgcggcaccagtcaatcatctgatttgaggtccagagggtaagcttatttccatcccagacggccatcgaggcatgcggctccatcgccatatggctctggtccggggtcgtgtaggtagcatcaatcttcaccgcagcggaggtgaaagccccgtcaaagtcaccgacgtttttgtcgggcgtgtcttccggcggctgattgacggcctgtttttcgtccgccagggagtaagctcctttattacggcgatagtgtgcctgcaccagcgaggccgccgctcgcgcctgttcgaaggtctcggccactaccagcgcaatggcctgatgatagtgctcaatagtggggccgcctaacagcctggcggtgtttttgtcgcctttgccgagtgccccggcgttactggcggtaatgacagccagtacgcccggcgctttttgcgcggcgtccgtatcaagggcggtgaggcgtcctttggcaatggcggaaccgacgatatagccataggcggcgttgggggcttcttcatgccattcgtaggcgtagcgtgccgtgccggtagttttcagcggtccgtcgatgcggtcatggggacgaccgacaaccttcagctgatcgatcgggttttcccctgcgggtttatcaaatttcatgcctgtgccctcgcttcagccagtacggaggcaagcgttcgcttcgccaacaggagtttaaaggtgttttcagcggtgggatgggcgctggcgaacagcgtgtcatatacggcctgcgccccctgggatagctgagcatccgcagcctcaatgcgccagggcttatgtgctactccgcccagcgcgacgcgcccgctgccgtcaggctgaataatcgccgcgaccgataccagggcaaaggcgtaggaggcgcgatcgcgcaccttacggtagatatgttttccgccgagcggtggaggtaacgtcaccgcaacgataagctcaccgggaagcagggcggtttcaatgtgcggcgtttttcccggagggtgataaaaatcagccagtgtgatactgcgagtctttccctccggcgtgatggtttccaccaccgcatccagcaaccgcattgcgaccgccatatcgctcggatgggtggcaatgcaggcttcgcttacgcctaccaccgcgtgctgacggctaaagccttcaagcgccgcgcagccgctcccgggcaggcgcttattgcagggctgattggtgtcgtaaaaataggggcagcgcgtgcgctggagcagattacctgcggtggttgcctgattacgtaactgaccagacgcgccagcgagcagggcgcgggagagtaccgcgtaatcacgacgcacgcgctcgtgagccgccaggtcggtgttccgtaccagtgcgccgatgcgcagcccacccgcgtcggtcacttcaatcttatcgagcccgaggccgttcacatcgataaggtgggtgggcgtttcaatttccagcttcatcaggtccagcagattggtcccgcccgcgataaattttgcgccgggtacgcgctgagcgctaagtgccgcctcggctggggtattcactcgttcataggtaaacgccttcatgattttatctcccccgcagcatcttcaatggcggcaaggatgttagcgtatgcaccacagcgacagatgttgccgctcatacgttcacggatctcatcggcagttgtttctggagcggaaaccaaatcgaccgtgacgtgactgggaatgccgtcctgaatctcttttagcaccgctactgatgagcaaatttgcccggaggtgcagtagccgcactggaagccatcatgcttgataaaggccgcctgcatggggtgaagattatctggcgaacccaggccttcaatggtggtgatctcggccccctgatgcatgactgcaagcgtcaggcaggcattaagcctgcgaccattgaccagcacggtacaggctccgcactgtccgtgatcgcaacctttcttggtaccgatcaaatgcagattttcacgcaaagtgtccagtagcgtggttcgggtatccacctcaagctgctcggttttgccgttcaccttcagtgtcaggggcattatctctggcgcgggtgtagctgccggaacgcttgccgccagcgtagaatgaggataaaccacggcggtcgccgctgttgcggcgctcactttaatcagatcgcgacgggtcaaacttaaatcgtgcggctcgtgcttcccaacccgattatcttcggggtattcgccttggttgctcataccaggcctccggtattctaaaggggaaaataagagtgcgttgcgagagtgctgatgcttttttaaacgttaagcatagtcggcgacagcaggaggattattcttaaaacgcgaatgcagctatgagcccggctaataaattcatgttcgccgggatgttgatgatgatgggagctggtttattgctttagttgtacgatgcaaaaaccaataaggaaacctgtgattttcagctctacatcaccctgcaaatctctgtcacttctaatataaaaatagggagaaatgatggagcttatattcattggcgattaggaaactatcttgttatacaaaacaatacagttctttacatttgccttgttttatgaatactcctgaagaggtgtataacataatggtacaagcagggtagatatgaatatatttgaacaaactccaccgaaccgcagacgttatggtcttgctgcattcattgggctgattgctggcgttgtttccgcattcgtgaagtggggggctgaagttccattgccgccacgtagcccggtggatatgtttaatgcagcgtgtggcccggaatcattaatcagggctgcaggccaaattgattgctcgcgtaattttctcaatccaccgtatatttttcttcgagactggttggggctgacagatcccaatgcggctgtttatacctttgccgggcatgtctttaactgggttggtgttacgcacattatcttttcgatagtgtttgctgtcggttattgtgtggtcgctgaagtatttccaaaaattaaactctggcagggcttactggcaggtgctttagcccaactttttgttcatatgatttcattccctctcatgggactgacgccacctctgtttgatctcccgtggtatgagaatgtttctgaaatttttggacatttagtctggttctggtctattgaaattattcgcagagatttacgaaacagaattactcatgagccagaccctgagatccctttaggctcaaacagataatgcattgaatgataaaaatggcgcaaatacagcgccatttttataggttaaaaacattgctttttatattctgatgcagatagtcagtgagtatatcgcgctacttcaggatgatgtagatccgaagaacgctacagaagagaggcattgttgctggcaaatagaagaagtatcgggttttgttacccctgaaaaacgaagccccgctattatcgctggcggggcagtgcaattaattattgtatgtttataacggtgtcagcccgtatttagcccttgcacgattgcaagcctcattgacgactccgttctcaccagacatggcgaattctctgcatgtggacgatcgatttttatatatcgtgcagcaggcatttttgcccggggttcctgcaagggcaatacatcgggggtttttctgattggtaccgctcatgcatcggtgaaaaggggatatttgttcagtgagcctggcgggaatagtaccgccagcatcgtcggcttcggcccagtaaaaagagacgcggaaaaatgcacaacaggcaccacacgtcatgcatggattcagattgctcataattcaccagtacagctaaaaatcgtaaagagaacagcggtacatcgtatgtaagaacgtaccgcggttggctggggaactttcgatagtgtgagtattgaatgatttccagccgttaccgattttacgtactaattcgtgattaaaccactcgttagcaggctgcctgatacctttccgtgtctcctgaacactatggtgtgcatatgagaaagcccatcgttacaggtgatattgacgatcgcttccacatcatttaaacgatttttggggctctgaggtggaattcttccctcgaccgatggataagtcttagtccgccgaagggggcttagccggacaggaatcgctaatcttaatgaatttgtcgttatagaccagatagtgattccccggctgacgtaactcaggctgatgaaccacgtctcccggacgtagataccaggcatcgccttcctcttcggtcgaatcacatcctggcttaatcagtagcttaaaccatgtgttgccagtgttacttaccgttcctgtcaccttgtcgaaggaccatttaaactgaacctgacgtggtcgtactaccagaatggtatccatcaccaccaccggctccgtgctgaccacgccgccggttgggctgcgtcttgtatggttacgagtggggacctcgcgaaatgagacccggtagtagcgctcgcggttatcccgtggaccatgatagtaaaatttaaaatactcgctctcaccagcctgcaacgccagctggcggggggcgaaaagcagttcaccatccaccggtcgggtgcgcaattcactgctgcccgggctatcaatagcactgatggcaatacggtatatccgtgcgcttttgttgttattcactacacgtttgctgacaaagtcagtctcggacggcagcgaaaatgtcagattgccgaccgaaatcgcctgtgtcaaaggtgccgccagcatacagaccgctgtcagcagggccttagttaatgttacgccacgtcgcctgaacatgaatctctcctgaagcgctgacttcgccaaaccagccgttatcatctaccgtacgcagcgaaatggcgttatccattggaatcgaaaatttgactgtggtcttatccatctgccccacttcgccagagatatcagtccacggtgtggtcaaccacagcgcatcggtcatatcccgccagctatcatcgcacccggcatcgtaggtttttgtagctccgttgcgggtaataaaggaaagtgtcgccgggaacggtactttcgccttaccgtcatcggagctgaagacacaataggagcgcccgccaatcacctgcgcgggtccggtcaccttgatcagcacttcgtcggcagctgttttaccgctggtggttacgatatagccgaaatcgagtgccgactcgccgctgccaacatatccctcccgcgacggtgtctgagtatattcatcggagataatactgatgctgaaatcacggggtttgataatcagcgtgttggaggtagaaaattcataccagccagactccggtgatgtggtgttctgaaagcgaaagttgaatagatctttggtgttgatatcgctgatcccgaggttcaccatctgcttaaagaagttgctcgagaagaaaacatagatcgagtctgcgctcttcatctcgttgaaggtgtagtaataggcggtattgctcaccggtttccatgaactgccattcagactgaactgcatatcgtacgccccgacggccgaggctaacgacgagttggcgatcgccgggaatatatggattgaggtgttgctgagtccgtttgtttgcagggtatagttaaccatcttacaacttaatcctgaacggctgccgatggtttgcgtccggcagtcggcgttcccttcgcccagagtcggtactccgtcgctgttgataaatacttccgccagcgagtgggtatttatcaaccgtagatttgctgctttcgtatgggtgacgttgcgaacataccagttgccggaggcctgatccttacagcgtgcgccgctgctggcgtcatagttcacagaggtctggcaggcattgatggtcattgtaaagctgctgccgacgggcatttgttgcatatactggtaaaacgcgtctgacaacatgccgtgcatccacttcgcgccgccgctggtcaccgtcgcgccataaaatccactggcgtcggtggtttgcggcaggataagactggtggtcatattacacccagcgtaccagttgatgcagcgcaagccagttaaaggagatgaaactggtgaattttccagccacatatcaaacttccagttggtataaaggccggtgttgtaaccgttatcaatgtagccgaggctttgctgatagatggttcctgaaccagtgtattttaaaccggtccagcggttggcaccggtcaggcgcggatccagcgccccgccaggagtgacgaaaaagttgtcgtctgagttgttttcgacaaacacaaactcgcgtgccggtgcatccgcccaggttgttttgctcactgccgctctgagcgcagttactggccagattagcgcgaaaattatcatcgttattagtaggttaactctcattctcttctcctgtctgcgtcaccgccgcccacgatgagaggccgctgcagaccacatcaccgacccagacggcaccgcgcgcctggttgagttccagagccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagacgacttttgcggccgctgacgatatcgtaactgtcgagtgagtttttgctgttctgtaactccacctcatatcttccatagggagagagcgggagatagttacgcttgccgttaagcgggaaaatccgcccgttgattttggcgctgatctgaccgtcgtcctccagcccggtgttgaatatcaccccagcgttgccatcagtccgcccgctggcagcaatgtttttaccctgccagccgacgctgccattggcggtcaagttggtattgacgtagccgtccgccgcgctattgacgttcagcgttccgctggcgtaacgagcgtcgaattgtgcatacgccccgccgctgagggttttgtcatcaccggtatcgccggagatggcacgtgacagattggcaccaacagtgcgaatggttccttcatcaaactgtttgcgtgctgacaggtttgccatggtgtagccgttttgatgagtcatccctgcgctaaaccagttgcccagtggtagcgagagatcgagagcgatatattttcctgtattggcgttgctgtcgccgttgttatagcgctgaataccggcccgcaggccaagcgaaccaaaggtaccgctgtagacattttgatagtaatctgccgtgtaataatggctgttgtaacggcggtcatcattgtagctgatgctgaatgtgcccagcttcgaccacagtgagttcaggttgagtgtgccgccgattgcacggttgtcggcatcgctacgtcgcaattgattgccaatgcgggttttttcctgattaacccacagcgaactaaagcctcccggtagagtggcgctgatgctgccgatgctgctccatgagctgtcactggccagcatattttgcaggttaacgttgatcgcccccccaagcggcagcgtcagacgggtttcacccaccgcctgattatcgtatccatatcccgttgccgcccagctaagcgtactcaatgagccggaggtcgaggcacctgctagccaactctctttagctggtcgcgtctttttcccgttttccgaccagcgatccatatgaaagctaccgccccatacctgccacgccagtggtgcaccgacgccgcgcccccggctaaacagcttattgacccgctgggtgcgtttgctgatcacgcgaccgttaacgatcacctcaacttccacatcgtaaatcccgtacggtagaccccgggtatccacttcatgattgcccatagtgaagttctgaacgcttagtagccgcccatcacgggtgagatgtacttcgcccgccgccggtaaaaaggcgatcactggcgtggctgactggctgctgtcgaagatggtggagctggcctggtttccccaggaaaggccgtaaatcttccctgctgaaatggcggtcatcggccctaaggactgcaagttccaggtgtcgagcattccaccggcaaatcggtgaccggcaaaatcgcgttcatacatcgctttatataattcactgtcctgttgaccgctaccgatcccgtacagcgagccgtcgagcaccacatgatgttcgcgcagtgcagtaacgttattcagcgacagatagctggatgtgttgctcccgccgttacgcaactggttgttatagacgcccaagttatagctcagattactgctgagggtgttaacactggactgcccgatgtcttcgctacgtgagcgtagtacggtgcccagcgcttcgcgcttgaccactagctgcagcagcagttggcgcaagctgagatccagctgcgcgttgtcagtcagggggatggtaagggcctcattgaacggggcgttggccagagccatcagctgctgtcgagtttgttcgctgacactggcgttatcttcactctcttccagctgtattttccggatgcgtagctgtccatcgtccagccagataaaagcgctgccgattcgctgatcgtcctggcgaccctggctaccggcgagatgaatatagagcgggacgctcatgccgtcctgaagcgcctgactgaaggcctgcggaataatcaccccacctatttgctgcgcacttatgtcagcagcgctggcatcgggctgaacgaacaaaaagaccatgccgaaggcaaactgggctttcagtcctggggagaaccgtcgtaaaggcattgtcgttatccatctgcacagctatctatttcacgggaatgaacttatcaccctgccaaagtgcaacccgtcctttgttatccgcagtgtccacgcgggtaaaacgacgcgacttgcccggcatcaggtagtaattctctttacactccttaccgttggcggctttcaggcaaggtccgtaggcgaggatccgcagcgtcgcatttcctgtatttgtcagggagccgttggcgtactgaaagtggtagttcgcctgacgaggggcgacgaccagaatggtgccgatgcgggcggaagcagtggccacagcgctgcggttggcattatcgcgctgcgcatcactgagggcctgatcaaaccagacaatgcggtagtagcgctctttttcatctgcgggtcccttatagaagaagcggatcacttcgctggcttgggcgggtagcagcaagctggcgggagtgagtagcaactcatccggcttgtccattgagataacctgcccgtcgtcaagcggtgaagagagccgttcgagacggatattgataaggcgaccactgtcggtactgtttttgatcgttttgctcagcgtgctgctgtcactgttcataaacgatgatatatcgccgacatccagcgcctgggccggagatattccggaaaacagcagagcgagaggcagaaggtgctttttcataacaattccgtccaggaataaagcaggggggctacccctgctggtacatcagagagattaactggtccaggtcgcgtcgaactgtacgctaacgtcgccgctccagatgccttccggtagagtgctgtaatctgttactgcggtggtaccattggtggtaccgctgatgatggagaaggtgaaaccatcctgtgcggtggtacgattgctggcattgtaaccgttagccagcgggctaaggttgccgcccagtacgccgttggcggtatcgatcatcacggtatcgccagttttttcgactgccgcgccgttataatccacgcccacattcagtgtggaacctgaggtatccaactgggttaatgtgttggtgataagacgtgaggtcagtttaaaggcggtagccgttgagtcaccctcgatagccacgtcaaatagacctttctgtgagttaaaacctttaatgccttcggcatactggaacgccaggctaccgagtggcgtcacaaccagcttactggtggtgtcttttttggctgttgccgaccaggtcgctacagcctgagctgttacgtcagcagcctgcgccacacccatgccggtaaacaccgttaccagagctattgccagaaccttttttttcattgcatttcttcccgagttgaattgaggacgtgatgtcccagtgagtcattttttaaaactaacttgcctggagtttactgaaccaacttatatatttttgagtacagcttggcctcagcattacgccgatgggtatacactgtcttcacactacaattttcaattctggcaatcgatttaggttgcattccctgggccgtcatgcggataatttccatttcccggtccgtgattttatctttcttaatatcttttctcaggaacctgccattaatcacatagaccagttcttttctaatatcacgactcagtccagcgtataccacgcccctaatattgctattgtaataccaataatttgctaaggcctctgactttctggccgcaatcaatacgacctgtttcccctttaccgcggataaccattcattatcacggtttataaattcagataaagaatccgtactgagattgataaacacgaaatcttttctaattttctccaacgatagataaattaatctgtcgatatccacaatcagttcagatagtcctttatagaagtaggcgtcatggggagaccagatgtatttatcagaacggttttgacattccatatggtttttaacctcatagtccctactgtaatcactttgccatgtcactactttccaaacctgtaatttttacaggtgcattcagtttccttagtaaaccggaagtaaataagatacgtagtacatatcaataaaggttaaacgagattaagtttaattattttcgattgggcttaaatttatgttttttttcccgatgagtgtcaatatgtgaacggaaaaggaattcaatggttaagtcaatatttagaaaaactgaaaatattgcttttttgataagaagaaaaagacatttggtttcataaggttattggcaatataacgttcaattcttacttgcattttatattggtcaggaactttgccctgaagtgttaggaatagtcttaatgcgctgtgtgatggactagtaaaaaaacaagttttaagggtaagggatagaatataaaactatgatgagctgtcattgaagatgatttgccaatcagtaagatattttaatggattaacatgccgcacaaaatggttacaggtgttcattccaataagtaatggaaaattgaacgggcgtatgtacgtcatctgttcggtaagcccccaagagccagattaagtgaagttaaacgaaggctgccagctgtcacaggaacgatggcctttttgtcagggcactgcattcagttatctgtgcgcgttactctaactggcactcgaacgtcggcgacggggttaccggtggatcagactgttcctgtggcgtaaacgtttttatgttagtaccaacagatttaccacatttatcatcttaacagtttgagtgaaaatgcaggctgcgccgcaaagggaggagactgagtggcgtgttcagtctaaaagagggttgatgccagcatacaggggcgaagctggtcaacaagtcaacattaagataatggaatattcggagagaaacgtcaggcagttggcctcaaatgaacaggaagaatatatccccaggaaaattaatgttggtgttataaacacaccaacattaatccgatctgattattaatcagacaaatatcgttaatccgtcgaattttgaatcaacgttttttcttacgaccctgaacggccttaaaacgtggattagatttacaaatcacatatagccgtccttttcgcttcacaatctgacagtctggatggcgttcttttgcggtacgcagagagttaagaactttcatcacgccccctttttcgtgctaacaaaacgaccaaaacgttgggtgaatcgtgcaacatttccttctgatgccactgttctcagcttccctgtatagaacgggtgcgatttagaagagacatcaattgtcacgtatggatacgttacgccatccagctcaatctcacggtctgttttgatagtcgagccgattttaaagtactcatcaacactggtgtcgtggaacaccacagtacgatactcaggatggatattgggcttcatcatttttacctgttatgttataacataaccataaagatacatgctcatccggatcatttcaacactcaatccctgtgactctttgtggatgtggaattttcgcaacggggaactctggcattgttagcagccattggtgacgctcccataaacgcctggatgagtgattgatgatggttttgctgagagtatggatttttcgagaatggaggttatctccactttactggccgataatttatcgcagtatgattgattacctgacagcgtgtattcctctcccacggatataataattacttacaaaaaagggagaggatgcatattttaaatatcactgaagtgaacagtttatttccgttattaatagaaatggagaaataaataggcgtattctacaattgcgacaaaaacaacgatattaatcagtttatgactgatttgctgtactttattctctttcattggtacttcctcgctttaaaaaagagtgcacttcgtaagtgcccttatataaataacgagtttggtcaaccaattttttgacatgtatcacaaatttgaatagatgtattacatcaactatcttttattgcaccaacgtcattgatatatgtcgcctgaagtcagttccgggaatgagtctgatctcaagactggcccagtccgggcgttgattggtgctgaggagcatatcgcatctcatcataatgtcgtatctcctggggtgttatacaagatatcgttgttggtgacctgggagaggaattgagttctattaaaccgtcaactatgccggatacatactggattacactgcaggcacgccttatgagagaacgtgccgcagtgacgggttaattatctgaaagaatttgtgaggctgtatcggttactcattgatttgatagttttactctcgggagaataatagatatttaatccattaacggaaaccagccagttcctttcgatgcctgaatttgatcccatagtttatccggaatggttaattcatgaacaagttgtgttatcgttcatgagaagcataacgtaaagggaaaagctcgattagacggcagaatttgtcaggggttatgaacgaaattcataaatctgtttgagtgttgcgatgggtagtgcaagttcgatatctccgcaatttacagtccgatgaaggaaaatgaatatccataaaaaatatattggtttatcctggcatatatacctatttcgacgtatttccaatagttttaattaaaggcaggtcattgttattcactctgaatagtgaattattcactgtccgcagagtaagaaatataacttaggtatctatttaatgacttgcacaaaaagctaaattttcccccataaataaaaatataatcccgcgcccaaccacctgatgagtggctataggcactggatatattaggtggcggtgcactttcttacataaaggtatttccttttctgcggaaaaggaaatcgggaaatccccggtttttctgacaagcagacgccattatttgtgtctgcctatgttcgttaattcgttcatcaggaaattatctcaatgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcataaagtcctcgggtcgttgtccactcttttggcatgtcagcatattcacataccgtaccagcaaaagtttcaaccgtgagcaaatcgaccgattttgttgacggttcaaacgtggaaacgaaatagatatccgtcttaaaattcttcatacatctggctaaatgatgacgtcgtagtttgacttcttcatccggtgatttattcgacacttcaatgtcatatttaaatgagttgccaaaaataggtgtctcaggaaagttgattaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggtgagccggacaagaatggcggcacgacaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatctcattctccgttaattctttgtcatatcgcacattttcgttataccctgggccctaagtgtatcaaaaatagcaagggcgaaggcaaaagcactggtagcgtctgcttcgttgtccccgaaaatagagaggtttcagtcctacattattaatgaattttttgcataagtgatatcaaaatccacatactactttgaggttacgttttaacgtagactcattgttcatgcctaatggagggactgacagtggaattttccgtatagtctgcttcagagtattgcagatgcccatcaaaaatcgatttctcactgacagataaagaaatggcacaaattagttcgcttgatttgggttatgttggggagtcggtaaaacattttaatcctgaatttgttcgtggttgtcttgctgtaaaaatacatgattgatattaatcatgtattttacctaagacgacaaaaaccttttaacagggagtgatattgatcttcactctgtcatatctccggtaatatggcgtcaggcttcatcatcagaaagggggcctgacgcctgaaaaagtgaacaacagacagtgttcggattatcaatattcagtttttaacgttgaactggattcattactgcgttgtttaagaatttcccgcgccgaatctgccattatcatgactgcacctgccagcatcagagtatctttcaataccaggcgaccagcaccggataaataagggaaaccatgatgagcgtcacccaatgcgggtacccatgcctccggggtggtgattaaaaatgagagtgttaccagcggcgtggtaaatgccatcagtcctcccaataaacctaaccagcgattgacaggattagccaaaaccagcagagcaataatcacctccacgacgccaagaccgttggaaaaaccataggtattattggccgtttgccatgcccttgcttctggtttgtattcgccttcgtgagtcagatactgtttatagtcttccgggtgttcataaaagaacgacattagtggactgtttgcgacgaatggtgtaatgctgtctgcctcgtaagggacaaactttaataacccaatccacataaaaacaattgcaatactcagacgaatcaatgtcaggccaattttatctccccgacttaacaggtgcaggtatttttccattgtgaacatccttatttatacaatactgctgttgcggttgaattattatcaattcgcatcgatgtgactttccaggatgaagcattatattttctggctatatcagcaatggtatcctccagaactgtcggtgatgctgatactgacgagacgctgatatgtttcagaattattttatcatctgcattggtggaaaatgccataacgccagataatagtgttgcaaataaaacagattttttaaacatataaaataccatcaatgaagtgattaagaagttatagagtaacagagaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaacatacgttgggttttattatcaacaatcgcttttaataccccacgagtatcattcatcactctggcacgcggaattgcagctacaggcaatgtcaccacctgaatatcagcaccactctctctggcttgttcttctgtcataccaaccctggacaggggcggtgtcataaatacggaataaggcacatttttccgatcatcagtactacgtttgccttcacccagtaactcatcacgtacaatgcggtaatcatccagtgatatgtaagtaaattgcagcccgccggtaacatctcccatcgcccaaatattgtctgcggtggtatgtaatcgcttgtcaacgacaattgccccgcgctcgtttactgcgataccggcattttctggatgtaacgaagcggtagccggttgacgaccggaagctattaacagtgcatccaccgccagttgggcgtgctcgctatgcacttgcacttgattttcatggtgactgattcgctccacatgggcattgaggataatatcgacgccctgatcgcgtaaaatcgtcgcgatattatcagcaatatcccgatcttcccgaggcaaaaacagcgaagctgcttctaaaatggttaccttgctgccaaaattagcgaacatagaggcgaactcaacgccaatatatccgccgcccaaaatacctaaatgcccaggcaattcttttagattaagtaatccggtgctgtcatatactcctggcgtggtggtaattccaggaattggcggaaccacggtttgtgcaccggtattaataaaaattttctcgccatgaatttccagatttccctcaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatgcagccgatattaatacaggtcccgccatacattgcatttgattgttcgatgagagccactcgccaacctgcttttgccagcgtgacggctaatgtttttccagccttgccaaaaccaataatcactgcctgatatttattcatgatgatttcctgtcgaaacgcgttcatttgacatcatgactatagacgcaaaagagcaaataacatttcttcacaacgcttgatattttgtcttatcgtctgatattttctttttcttaatcagaatcacaaaacaaaaatcatgattaactatttgatggtattagattagttatttactaagattgttggtgtttgtaatcaaaaaccactcaggagtctgatatggatgcccttagccgtttgttgatgcttaacgctccacaaggaacgatcgataagaattgcgtgttaggaagtgactggcagcttccacatggtgccggggaattatcggttattcgttggcatgcgttaacgcaaggagcggcgaagctggaaatgccgacgggggagatttttacattacgcccgggaaatgtggtcctgctaccacaaaattcagctcatcgcctgagtcatgtcgataatgaatcgacctgtattgtctgcggcactcttcggttgcaacattcggcgcgttattttttaacgtctttgccggaaacgctgtttttagcaccggttaaccacagcgtggaatataactggctgagggaggcgatcccgtttttacaacaggaatccagatcggcaatgccgggagtggatgcactgtgtagccagatctgcgctacattctttaccctcgcggtgcgtgagtggattgcacaggttaatactgagaaaaacattctcagtttgcttctgcatccacgtcttggtgcggtaatacagcaaatgctggaaatgccaggacacgcctggaccgtcgaatcgctggccagcatcgctcacatgtcccgggcaagttttgcccagcttttccgtgatgtttccggaaccacgccgctggctgtattaacaaagttgcgtctacaaatagcggcccagatgttttcccgggaaacgctccctgttgtggtgatcgctgagtcagtaggctatgccagtgaatcatcttttcacaaggcgtttgtccgcgagtttggttgtaccccgggagaatatcgggaaagggtcagacagcttgcaccctgaataaaaccgccagaaatcagggcaaagataatccgcattccgggagttgtgagcctttcaactatttctatttccaacggtggtttgggctttatatattttttctgatggactctagctcagtttttaaataaaaatgcaaactaaattgcttcaattaaataaaatcccgactattacttgatacgtgattattgtcggtgatttttttgtacaccatcagtgtatatctcaataacccctgaataagtagctctgaataggtataagggatgtagccatttttaaatggatttcttatgccaaaaatgatcgtcgatttccccataaaatgtgagcgatgccgaaagaaataaaattagttattgcatttgacgtttggatgaaagattatcatttgtcatacaaatgaggggtggtatgttgctagccaattaaaaaagaacgccatatttattgatgattgatcccccggtgggggggaaacatcgggcataaatgggcatgaagtaatggagtattagttgtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagcggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgcaaaggttgccgcgcgtatgcaggatctcacctcttttattgttaataaattaggggtagtcgatgtaggtgccagtttgcaagggagagcggtgtatcacccatcttgtagcctggcccgtaagctgggagtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctaaacatcagtgggcgattacaacgggaagggcagaaagtcaaagtgatgcatattgctgaagtgttgatgagccgctgaggatataaagatgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctattttgcaagaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagctgggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcacagcttgtgacaacgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcgaggcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcgtgattagcggtgacacgaggctggaggaattggggattagcgaacgtttgcagcaggaatgcaatgccgttgtttgggatccggcgaaaggtgccgagaatatctcgcaggcagagcaggctaaagtgggtgttgtgtatgctgaatatggtttaaccgaatcgggaggcgtggttcttttttccgccgccgagcgcgggcgttcattgagcctgctcccggaatattctctttttatcctgcgtaaaagcactatcctgccgcgtgtagcgcaactcgcagaaaaattgcatcagaaagcgcaggccggtgaacgaatgccttcctgcattaacatcattagcggccccagttcaacggcggatattgagcttatcaaagtcgtcggagttcatggcccggtgaaagcggtgtatctgattattgaggattgttgagagagatatgaagtctggacataaacctgaagaaggcatacgaggttgaaaatagcgtttaggacaacctgacttaaccccgttccgtcatggttatgctgctcttctgtaaatatcctggtattaccaatgccaggatatttacagtgaaaaagacaggcatccattcctgaaaacgggttcccttcccggtcattgtcacttcagctttatacaggcactctctatcagaatgttgtttattactgcccagagttttgttggtattcatctaccatttttttgacaaggcaaaacattacagaaattacaatgcttagaaaaaatcccagagccaggcaaatggcagcagggtatttattttttatttctggtgagcttatagttacacagccatcaccgttcggatacaatgaccagttcctggtcaggtatatcatttttgtataaagctcactgttaattgctgaaggcgtttgtatctcatcgagaacttgcctgccattatgatattctgacgcataccatttgataatagaggcctgcacgcgagatatttcctcttcagcagttggtaaagctctcttatctcctgaccattccagccttatttctctgttcttgacatctgggctggtgtgaaaaaatgtagtaattcgctgaataacatcttcagtcattgtagtctgacaggcaaaattattattgctatcacagctaacaagtatacctggcgttgtctggtttatttttaggctgtaaatcacttttatattgtctttattgatatacagaaacaacagcaccatagccatacatatagccataataaaaaggataacacgaatctttttcttcagataaaataaaatctcaatcagatcgatatcctgtttgatttgttcacgcataatatatccagagaataaaatctgtcgcagataaggttgtattaatagtctgtatcaggaatgttcgggttaaatatcagcaaaaagcccgcatcatgaatactggatatgaagcatgagagttacctcagtgtttatataaggattcggtccccctctctggaacggtaactctcaatctgatcggttcctgcgttagttcacatcacgactcattttttcgctctcaccggcatcccatttgccacaaaatatcccgccgtgctcctcggcagcgcttcctgtccacgaatcatatccgctattttctcgccaatcataattgtcgtggcgttcaaattcccggtgataatctgcggcataatcgacgcatccaccacacgcaggccttctaacccgtgtacgcggccttcgccgtcaaccacggacatctcgtcgtaacccattttgcaggtaccgcacggatggaaggcggtttcggcgtggttacgcacgaactcatcgagctgttcatccgtctggcattcgacaccggggctgatttcgcggccacgatactgatccagcgcgggttgatgcatgatctcgcgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcattgagccgacgtggcactggaaaccgtgctctttcactgcattcgagccgttatagttaatcgctactggcaggaaatggtactgaatattcggccacgcaaattcctcacggctgcgaataaatccacctgcttcaaagtggttgctggcaccaacgccagtgccgccaaacagccactccgcaccgattttcggctggttccaccactgcagggcagggtagagggaaaccggttctttgcactcatattgcagatacatctccagatgatcctgaagattttcgccgacgccgggtaattcatgcaccagcggaatatcaaactccgccagcagttcagcgttgccgacgccggagcgttgcaggatctgcggtgaggcaatcgcgcctgcacataacagcacttctttgttggccgttgcgcgggttgggatggtgctgtcgccttccagccattcgacgcccaccgcgcgtttgccgtcaaaaatgatgtgatcggtcatagcgtgagtacgaatggtcaggttaggacgcgatttggcctgatcgagatagccacgcgcggtgctggcgcgacggccctgcggcgtgacggtgcgatccatcggaccaaaaccttcctgctgataaccgttgagatcgtccgtgcgcgggtagcccgcctgcacgcccgcttcaatcatcgcttcaaacagcggattgacgccgggtttggaggtagtgacgctcaccgggccatcaccgccgtgatagtcgttttcacccatatcgcgagtctcggccttgcggtagtagggcaggcagtcgaggtagctccagttctccagaccgggttcttgcgcccagttatcgagatccagcgcattgccacggatgtagcacatgccgttgatcagcgacgatccacccagacctttaccgcgtccgcactccatgcggcggttattcataaacggttcaggttccgtttcataggcccagttgtagcgtttaccctgtagcgggaatgccagggcagcgggcatctgggtgcggaagtcaaagcgatagtccgggccgcccgcttcaagcagcagcacggaggtattcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcacgccgttctcgcgaccaatgccggagtgtttgtagccgccaacgggcatctctgccggggattcgccccaggtgttgatccagcaaatacccgcttccagctgatgaatgacgcgatgcgcgcggttcaggtccgctgtcacgatgcccgccgccaggccgtagtcggtatcgttagcgcggcgaatgacttcgtcttccgactcgtaggtcagaatggacatcactggcccgaagatctcttcacgcacgatggtcatatcgtcgctgcaatcggtgaacactgtcggtgcaacccatgcgccgttatcgaagccatcgcctttcagtacatcgccgccgcacagtacgcgcgcgccttcctctttgcctttggcgatatagcgcagcacgttatcgcgatgcgggaagctgaccagcgggccgaagttagtttgcggatcgaaaacgtcgcccgcgcgaatgcgctcaacgcgcgccagaattttctgctcaaatgcggctttgcatttcgccggaacgaagacgcgggtgccattggtacacacctgaccggagctgaagaagtttgccatcatggcgatatcggcggcgagatcgagatccgcatcatcgaaaacgatcagcggtgatttaccgcccagttccatggtcacttctttcagggaagaggccgccgagttagccatcacttttttgccgctggcgacaccgccggtaaatgacactttggcaatgcccggatgctcggtcagatattgcccggtctccgcgcccacgcccggcaacacgttaaatacgccgtccggcaggcccgcttcgctgtaaatttcagccagctttaacgcggtaagcggggtaacttcgctcggtttgaaaatcattgcgttgcctgccgccagcgccggggcggatttccacagggcaatctggatcgggtagttccatgcgccaatccctgccactacgcccagcggttcgcggcgggtatacacaaaggacgtttcacgcaacgggatctggctgccttccagcgccgggatcagcccggcgtagtactccagcacgtccgcaccggtaacgatatcgacggttgaggtttccgaatatgcttttccggtgtcgagggtttccagttttgcgagttcgtcattgcgttcacgcagaatatcaacggcccgacgcagaatacgcgagcgctccatggcggtcatcgacgcccagattttttgcccctgctgggcgcttttcacggcgcgatcgacatcctcgcgcccggcggcctgcacggtcgccagcacgttaccgttggccgggttaatggtctcgaaggtgcgaccgctggtggcggaggtataaccaccatgtatataaagctgctgttctgccattcgggacatcacgtctcctcggttaatcggtgggtagatgctgagtgataaagtggcgggtcagggaattagcgcgggttttatccagcggtttgccgctcagagccgcgcgcagccataatccatcaatcagcgcggccaggccgtagcccgcttcctgtgcctgttcgcgcggcaattcgcgacgaaactcgctcaccagattcgacagcaagcggcggctgctgacctgctgtaaacgatagagcatcggctgatgcatactgctggcccagaacgccagccaggctttcatcgccgcactgctcacctgcgtttcatcgaagtttccgccaacaatcgcctgtaatcgctgctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagtgtggcgtcgatcagttgtctgcgccggatcgactgcatccccaatttgggcattttcgccactccattcatcagcggtgtttatctattaaagcggttattgattggacgttcaatataaaatgtgtcttaattgttacgaatttgattttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgcatatggcgctgtttctcctacctcttgatacgttatatctatacggttaagcccttagtatctattgatgattaccagacaacagataataaaaaagaaaagaactattgcagcccaaaacctacatttgggctgttgcgaatgttcaataagtttagtcttatttaatgtaaatattgctgatcatttgaaatgacgcattattcatgagaaatgtgtatcgtaaatcaactgaaattaacgcaaccatttgttatttaaggtttaattatctgtgtgtgatattttattgaatgttttaaatattgtttttattggcattgctataatattggttatcatttgctgaatggattcagtcttaatgagtgggtttttaagggacaggcatagagtaatgatacgtatgcataaccaacatctttactcattatgtcattgaatgttgacgctatgtgtttatgagggagaggtattttcagttgatctggattgttaaattcatataatgcgcctttgctcatgaatggatgccagtatgtagtgggaaattataaatattgaaatagtccaactacttctttattaccaaaaatgagtatctgaattttaatattgcattcttgcgtgattatctcctgagtttgacttgtgattacctttttaaggtatttagcgtaactgtttttgagcgagcatcagaggtaaagataatcttcttgatagtgatgtgggatgttatacgtatggcatcgctgatgtttatggttaccccttatgtgtgctcaggaatcgacaggtaatcactcatactgaacagcgataaaagataaaggtgtgttcatgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagacaatttcacatcaaaagaaacagctctttgagaaactggggattcagagcgatattactttctggcgcgatattttctttcagtacaatccggagatcatatccgccacggggagtaatagtcacagatatattaatgataatcactatcaccatatcgtcacgcctgaagccatcagtctggcgttggaaaaccacgaattcaaaccgtggatccaaccggttttctgcgcgcagactggcgtactgacgggctgtgaggtgcttgtccgctgggaacatccacaaacgggaattatcccaccggatcagtttattcctctggcggagtcatccggtcttattgtcataatgacccgccaactgatgaaacagactgcggatattctgatgccggtaaaacatttgctgccggacaatttccatattggcatcaacgtctcggcgggttgttttttggcagcgggatttgaaaaagagtgtctgaacctggttaataaattaggtaacgataaaatcaagctggttctcgagctaacggaacgtaaccctattccggtaacgccagaagccagagcgatatttgacagccttcatcagcacaacattacctttgcgctggatgactttggtacgggttatgcgacctatcgttacttgcaggcgttcccggtcgattttattaagatcgataagtcatttgtgcaaatggcgagtgtcgacgaaatctccggtcatattgtggacaatattgtcgaactagcgcgtaagcctggtctgagtatcgtggcggaaggggtagaaacccaggagcaggcggatttaatgatcggtaaaggcgttcactttttgcagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgacccgtagcagaatgctgagtcgccagtaacatgcgcgaatcctggcgcggattatggatttgtcgggtaaccagcagggattgcgtcatcgcctcacggaccatgtaatccggcaaaaaaccaattccttcacctaaaatctggcactgacatttggtgttgaaatctggcaccagaattgactcctgcccgtgcagcaaccagcccacttttttattaatcgtatgcgcggtgtcctccaccataatattagggtagagacgcagttggctttcggcgatgggttccggcacaaaggctaacgggtgatccggggcgatagcaaaagcccagcgaatcgcgccaatttcagtgtaatcaataccgccgccgtccagtagtgtatcgggtgcgccgatggcgatattggcctgattattaataatcgcatcccagacgccgttatacacttcggtggtgacggtaatctggcaggtaggaaactgctttttcagcacctgtaacaagcgtgcggtgtgtttgggcgtataaagcagctgattaatacaaatgcgcacacgcgcttctatgccctgcgaaatagtatcgattctgcgtttgatggcataaaaatcattcagcaggtcggtagctttgcggaaaaaataacgcccggactccgttaactcaatgctgcgggtactgcgagtgaacagcaccacatccagccccgtctccatacgcttaatggtgtagctaatggcggaagtggttaaacccaactcttctgcggctttactgaagctgccaaaacgcgcagcggtagtaaatgccaacagattctcttcggtaaaaattgagttcattaaaccattctcgccattatctactatgaatttctccagctatgactgtagaggtatcggttaaagatagataatcatttttgaataacttttaatacccgtcgcgtttagtcgtcgcttcgcttaatttttgtccaccatattctgaaattacccccacgcagttacccgccagaaaacccagtaacgtcaccgtccagttcatcccgctggcaaaaaacagcgtcatgccgagaaagccaccgggaataaaggacagtaaccagaaacgcccttgccagaccactaccgccgagaagggtacggtagtaattacgctcgcccagaacgcggacagtccacttacagaggccagccaaccagcagtcagcgcggcgaaaaacgcccacaccatcccggaataattaaccgccagacttctgataaaccccgatttaccgccgcctgcggcataaaaactgcaaaaggcgacgaagccaatggttcctaataattcccatccttgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaacctgattgagtgaaagggtatcgggtcaaagaaacaaatattgcactaccgcacactgcgaaaagattgttgaatattattcaacaaaaaggcgagatacggcgaattaaatttaagcgggttcttttatcagattatcgttgctattctcaattcatcgaaaacagccacaaaaaccaggggaatgtgaatgagtataaaaaatctacctgccgactatttattggctgcacaacagggtgatatcgataaagtaaaaacctgccttgcgctgggtgtcgatattaatacctgcgatcgtcaggggaaaacggcaattacgctggcaagtttatatcagcaatatgcttgcgttcaggcattaattgatgccggagcggatattaataagcaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgtaggctggacgccgctactggaagcgattgtgcttaatgatggtggtattaaacagcaggcgattgtgcagttattgctggaacacggtgccagcccgcatctgaccgataaatatggcaaaacgccactggaactggcgcgggaacggggctttgaagagattgcgcagttactgattgccgcaggtgcataaaccgggaggcttgctatcaacacaccagaaagacggtgtgtgtgggcgctaactgcggatgcggattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttgatgatctgttccggcatggtgataaggttcagtttgacgatcaaggtattacggttggtcaacatcttcatatagagatgagtcgttgtcggcgttggctgtccccaaccttgcaaatgaccgctgtgaattttcaccttatcgcctggctacagtggcacgacattattcatcagcacctgggggaaaatgaaaccctgtttaattatcgcggcgataatccgttttatcaggcgttaaataaagaattacatattaaacgacgggcagttattcaggccgtaaacgataaacaaaatatcgcctcagcggtcgccagtatgatggggttagggattggccttacgccatcagccgacgattatttaacaggtctggcgcttattttatttattcccgggcatccggcggaaaaatacaaagaggaattttatctcggtctgcaacgcggcaaaaataataccacattattaagtgccataacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagccaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaataaaggcgtgctgaagaatttaggactgctgacgccggagctggagcaggcgaaaaacggcgacctgatgattgtcatcaatggtaaatcgggtgcggacaacgagcagttactggtggagattgaagaactgttcaacaccaaagcgcaaagcggctcgcacgaggcgcgttacgccactattggcagcgccaaaaagcatatcccggaaagtaacctggcggtgatttcggtcaacggtctgtttgccgctcgcgaagcgcgtcaggcgctgcaaaacgatctcaacgtgatgctgttttccgataacgtctcagttgaagatgaactggcgctcaagcaactggcccacgaaaaagggctgctgatgatggggccagactgtggcacggcgattatcaacggcgcggcgctctgttttggtaacgccgtgcgtcgcggcaacatcggtattgttggcgcatccggcaccggcagtcaggagttgagcgtccgcattcatgaatttggcggcggcgtttcgcaactgattggcaccggcgggcgcgacctgagcgagaaaatcggcggcctgatgatgctcgacgccatcgggatgctggaaaacgatccgcaaactgaaatcattgcgcttatctccaaaccgcctgcgcctgcggtggcccgcaaagtgctggaacgtgcgcgcgcctgccgcaagccggtggtcgtctgcttcctcgatcgtggcgaaacgccagtggatgagcaggggctacagtttgcccgcggcaccaaagaggcagcgctaaaagcggtgatgctctccggcgtgaaacaggaaaatctcgacctgcatacgcttaaccagccgttgattgcggatgtgcgtgcgcgtctgcaaccgcagcagaaatacattcgtggcctgttctgcggcggcacgctgtgcgacgaaaccatgttcgcggtgatggaaaaacatggcgatgtctacagcaacattcagcccgatccggaattccgcctgaaagatatcaaccgcagcatcaaacacaccttcctcgactttggcgatgacgacttcaccaatggcaagccgcacccgatgattgaccccaccaaccgcatcagtcgcttgatcgaagaggcgcgcgatccagaagtggcggtgatcgtgatggattttgtgctcggatttggatcgcatgaagatccggtcggctccaccatcgagacgatcaaagaagcgaaagcgatcgccgctgccgaaggacgcgagttgatcattctcgcctatgtgctgggtaccgatcttgatacgccatcgttagaacaacaaagccagatgctgcttgatgccggagtgattctggcgagcagcagcaccaataccggattgctggcgcgtgaatttatctgcaaaggggaggaagcctgatgagccagtcactgtttagccaaccattgaacgttattaacgtcggcatcgccatgtttagcgatgacctgaaaaagcagcatgtagaagtgactcaactcgactggacgccgccggggcagggcaatatgcaggtggtgcaggcgctggataacattgccgattcgccgctggcggacaaaatcgccgccgctaaccagcaggcgctggagcgtattatccagtcgcatccggtgctgattggttttgatcaggcgattaacgtggtgccgggcatgacggcgaaaaccattcttcacgccgggccgccgatcacctgggaaaaaatgtgcggcgcgatgaaaggcgcggtcaccggagcgctggtgttcgaaggactggcgaaagatctcgacgaggcggctgaactggcggcttccggggagatcaccttctcgccgtgtcacgagcacgactgcgtgggatcgatggcgggtgttacctcggcctcgatgtttatgcacatcgtaaaaaacaaaacctacggcaacatcgcttataccaacatgagcgagcagatggcgaagattttgcgtatgggcgctaacgaccagagcgtgattgaccgcctgaactggatgcgtgatgtgcagggaccaatactgcgcgacgcgatgaaaattatcggcgaaatcgatctgcgcttaatgctggcgcaggcgctgcatatgggcgatgagtgccataaccgcaataacgccgggacgacactgctgattcaggcgctgacgccggggattattcaggcgggttattccgtcgagcaacagcgcgaagtgtttgagtttgtcgccagcagcgactacttctccggcccgacgtggatggcgatgtgtaaagcggcgatggatgcggcgcatggcatcgaatacagcaccgtggtcaccaccatggcgcgtaacggcgtcgagttcggcctgcgggtcagcggcctgccggggcaatggtttaccggcccggcgcagcaggtgatcggcccgatgtttgccggttataagccggaagattcggggctggatatcggcgacagcgccatcaccgaaacctacggtattggcggatttgctatggcgaccgcgcccgctatcgtcgcgctggtgggcggcacggtggaagaagctattgatttctcccgtcagatgcgcgaaatcaccctcggtgaaaaccccaacgtcaccattccgctgctcggttttatgggcgtgccgtcggcaatcgacatcacccgcgtgggtagcagcggcattctgccggtgatcaacaccgccatcgcccataaagatgcgggcgtcggcatgattggcgcgggcattgtgcatccaccttttgcctgcttcgagaaagccattcttggctggtgcgaacgttacggcgtctgacctacatgttcatgccggatgcggcgtgaacgccttatccggcctacgaatggcgcaagaatctgtaggcctgataagcgtagcgcatcaggcatttgtcaccattgccggatgcggcgtgaacgccttatccggcctacgaatggcgcaagaatctgtaggcctgataagcgtagcgcatcaggcatttgccaccactgccggatgcggcgtggacgccttatccggcctacgagtggcgcgagaatctgtaggcctgataagcgtagcgcatcaggcatttgtcaccattgccggatgcggcgtgaacgccttatccggcctacgagtggcgcgagaattgtaggcctgataagcgtagcgcatcaggcagtctggcgttggtcataaccccatcaccctctgtagcggacataacaacatgaaagagcttgtggtcgttgccattggtggcaacagcattatcaaagataacgccagccagtcgattgagcatcaggcggaggcggtgaaagccgtcgccgatacggtgctggaaatgctggcttccgattacgacattgtgctgacccacggcaacgggccgcaggtcgggctggatttacgccgtgcggagattgcccacaagcgcgaagggctgcccttaacgccgctggcgaactgtgtggcagatacgcagggcggcatcggctatctgatccaacaggcgctgaataaccggctggcgcgtcacggcgagaagaaagccgtcaccgtggtgactcaggtggaagtggataaaaacgatccaggttttgcccatcccaccaagcccatcggcgcattctttagtgacagccagcgtgacgaattacaaaaggcaaaccctgactggtgttttgttgaagatgccgggcggggctatcgccgcgtggtcgcctcgccggaaccgaaacgtattgtcgaagcacctgccattaaagcgctgatccaacaaggttttgtcgtaattggcgcgggcggcggtggaattccggtagtgcgtactgacgcgggagattaccaaagcgtggacgcggttatcgacaaagatctctctaccgcgctgctggcccgtgaaattcacgccgacattcttgtgatcaccactggcgtcgaaaaagtgtgtattcactttggcaaaccgcagcagcaggcgctcgatcgggtggatattgccaccatgacccgctatatgcaggaagggcatttcccgcccggcagcatgttgccaaaaatcatcgccagcctgacatttttagaacaaggcggcaaagaagtgattatcaccacgccggaatgcctgcctgcggcgctgcgcggcgaaacgggcactcatattattaaaacgtaaggacgtaagatgaaagaaagcaatagccgccgtgaatttctgagccagagcggtaagatggtcaccgccgccgcgctgtttggtacctctgtgccgctcgcccatgcggcggtagctggcaccctaaactgcgaagcgaacaacaccatgaaaatcactgacccgcattactatctcgataacgtgctgctggaaaccggttttgactacgaaaatggcgtggcggtgcagacccgcacggcgcgccagaccgtggagattcaggacggcaaaattgtcgccctgcgcgagaacaagctgcatccggacgccacgctgccgcactatgacgctggcggtaagctgatgctgcccaccacccgcgacatgcatattcatctcgacaaaaccttttacggcgggccgtggcgctcgctcaatcgtccggcaggcaccaccatccaggacatgatcaaactcgagcagaaaatgctgccggaactgcaaccgtacactcaggagcgggcagaaaaactgattgatttattgcagtcgaaaggcaccaccattgcccgcagccactgcaatatcgaaccggtttccggcctgaaaaatctgcaaaatttgcaggcggtgctggcgcgacgtcaggcgggctttgagtgtgaaatcgtcgccttcccgcagcacggtttgctgctgtcgaaatctgaacctttaatgcgtgaagcgatgcaggcgggggcgcattacgtcggcggcctggacccgaccagtgttgatggcgcgatggaaaaatccctcgacaccatgttccagattgcgctggactacgacaaaggcgtcgatattcacctgcacgaaaccactccggcaggcgtggcagccatcaattatatggttgaaacggtagagaaaacgccacagctgaagggcaagctgaccatcagtcacgcctttgcgctggcaacgctcaacgagcaacaggtagatgaactggcgaaccggatggtggtgcaacaaatttctatcgcctcgacggtgccgattggcacgctgcatatgccgctcaaacagttgcacgacaaaggcgtaaaagtgatgactggcactgacagcgttatcgaccactggtcgccttatggtctgggcgacatgctggaaaaagccaatctgtacgcgcagctctatattcgtcctaacgaacagaacctctcccgctcgctgtttttagccactggcgatgtattgccgctgaatgaaaaaggcgagcgtgtatggccaaaagcgcaggatgacgccagctttgtgctggtggacgcctcctgttccgccgaggcggtggcgcgtatctcgccgagaaccgcaacgttccataaagggcaactggtgtgggggagtgtggcaggttgatgcgcatttgaaacgcctgcaacggtgaatagtaagagatttaagccccagggagtggggcaatctgaatatgagtgtgtcggcagaaatggacattatctttgaggaatatgcccttattgacgttgtgtagataactatttgtctacgtgaaaagatcatcagttttgccgattttagtcttttacagatagcaaatatcacacttacaggcgctcgccttatggggaacgttgctgctctgtttcattcaggctcgcggcatgttggggctggatcgggtggtttaaatattggctatattcaatggacgcgttttgccgcgatgacatatcaggcgttgccaaatacacatagctaatcaggagtaaacacaatgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactgaaaaaattaataaataccctgtggtttaacatattaacttcgctctccacttaactttttagttaaggagagcgaaataatatcaaagtagcagtaaaacctataacgtaaatttaaattgttaaattaacgccctccagtacacaatacttcacacgttagttatgagcgatttctgatagtgcctggtttaatcagagctttattatctgcgacgtttatttttatttaagagagatcgcgatgatatcattaaaagctccgcacaataatttgatgccatatacgcaacaaagcatacttaatacggttaaaaacaatcagttaccagaggatatcaaaagctccctggtttcctgtgtcgatatattcaaggttttgattaaacaatattatgattatccttatgattgtcgtgatgatttagtcgatgacgacaaactcattcatctcatggctgccgtacgagactgtgagtggtcagacgataacgcactcaccataaatgtgcagtttaatgatttccctggattttatgactggatggattaccctgatcacccggttaagtttgtttttcacatacttgaaaatcaaaaagggacagtttgggtatatgaccaggatgatgcgtttcttgatattaaagcaaacgtgcaggctggacgctttaccgggcttaagaaattagtgcagtttatcgattcagtgcgaacagattgcaaatgtattcttcttgaataccatatgcctttgctgagaattttccctaaagggaaagagtgtatgcatgtggaaaaatggcttcgcgaaatgtcgtctattccggagacagacgcgcccattaagcaggcgcttgcgcatggattattattacacttaaaaaatatctaccctgtttttcctgaatcactggtgatgttattgctctctgttctggacgtaaaaacatacagagatgatgcgcgattaaatgaatggatatctaatagagtgcaggaattaggtgacagatattatcctgtaaataagcacgttaaaatccgctacactctttagttcagaaagggttccacctgcaagttgttattccacctgagagtgaatcgcaatgcaggtaatcatttcatctgtatatctgtatgccaactggcattccatctcttttttcgccgatattttgttgtgatcggcgacacttcgcttaaaaaagcaccagtagtggtttcgcagccatgcggtgtataaaaaatgatctcatgcagatgttttgtgaatgtgttggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattatcatccctgcaaagtggaacattgccattgtttggctattcaggatggggcagaccaatgaaaaaagcccacacaggggagagtgggctgaaatgggaagctaaagactcaagtaaacttatcggaaataaggaccacgcattacgggggctatcatcgccgatggccgtgattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcacagcgggcaaagaaaacgcctgactaagaaaaactcgccagataattgatgcgagcacaatccccgcccaggccattaaacgtgcccatgttggtgtttcggcatttaatgttactgagaaaatactgataaaaaataaaacggtttgcgggttagagagatcggtaattaatccgcggcgaaaaaagacataccagggggcgctaatcggttgttgtagtgtgctcatttgcggtgttgactggcggcgcatgctgcaccacgcaaaccataagagataagcgccgccgacgattctgataagcgaaaaaatctcctcacactgcgtaattagcgttgcaagaccaaacaaacccaacccggaataaaatgcatcgcccagcgccacgcccagcccggtcagcacccctgcgcgtcgaccggaagccaggctggtttgtactaccacaaagagattggctcccggattaaaaaaagtaatcacgaacagtcctacggtcaggtaaacggcatgcaaaggatccatagtgatttcatccataaataagtgaactaactgcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgttagccgttaccaatgtctatgccgctgaattgatgaccaaagcggaatttgaaaaagttgaatcgcagtatgaaaaaataggtgatatttcaaccagcaatgaaatgtcgactgcagatgcaaaagaagatttgatcaaaaaagcggatgaaaaaggggctgatgtgttggtactgacctccggtcaaactgacaataagatccacggcacggcaaatatttataagaagaagtaattctgaatcctatgtaaacatctccgatgcgtaagtttatcggtgatcatctattgaaatttatgccggataaagcgttcgcgctgcattcggcagttcagcttttcagccgccgccagaacgtcgtccggctgatgcctaaataattcgccgctgctgttttatcgccattaaatttctccagtgcctgttgtggtgtcagtaagcgtggagcgggagttttcgccgactcgcgcgccagttccggcagtagcagttgcataaactgcggcgttaaatccggcgtcggttccacacttaaaaacagcgccagtcgttccatcatattgcgcagttcacgaatattgcctggccagtcgtagtgcagcagcacagtttcacttgcctgtaacccctggcgtaatgcagcagaaaatggggcggagagcgccgccagagacactttcaaaaagctttccgccagcggaagaatatccgccacccgctcgcgcagtggtggcaattgcagacgcaaaatactcagccgataaaacagatcacggcgaaaacgtccttgctgcatatcttcttccagattgcagtgagtggcgctaatgacccgtacatctaccggaacaggctgatgcccgccgacgcgggtgacctctttttcttccagcacccgcagcagccgggtctgcaaaggtagcggcatttcgccaatctcatccagaaacagcgtaccgccgtgggcaatttcgaacagcccggcgcgacctccgcgtcgcgagccggtaaacgccccttcctcatagccaaacagttctgcttccagcagcgattcggcaatcgccccgcagttgacggcaacaaacggatgcgactttttgccctgtcgcgcatcgtggcgggcaaaatattcccgatgaatcgcctgggccgccagctctttgcccgtccccgtttccccctcaatcaacaccgccgcactggagcgggcatacagcaaaatagtctgccgtacttgttccatctgtggtgattgaccgagcatatcgcccagcacgtaacgagtacgcagggcgttgcgggtggcatcgtgagtgttatggcgtaacgacatgcgcgtcatatccagcgcatcgctgaacgcctggcgcacggtggcggcggaatagataaaaattccggtcattccggcttcttctgccaaatcggtaatcagccctgcgccgaccaccgcttcggtgccgttagcttttagctcgttaatctgcccgcgtgcgtcttcctcggtaatgtagctacgttggtcgaggcgcaaattaaaggttttttgaaacgccaccagcgctggaatggtttcctgataggtgacaacgccgatagaagaggtgagttttccggcttttgccagtgcctgtaacacatcgtagccgctcggtttaatcaaaataactggcactgacaggcggcttttcaggtacgcgccgttagagccagccgcgatgatggcgtcacagcgttcgtttgccagtttcttgcggatgtaggtcactgctttttcaaagccaagctgaataggggtaatgttcgccaggtgatcaaactcgaggctgatatcgcgaaacagctcgaacaggcgcgttacagataccgtccagataaccggtttgtcgtcattaagccgtggtggatgtgccatagcgcaccgcaaagttaagaaaccgaatattgggtttagtcttgtttcataattgttgcaatgaaacgcggtgaaacattgcctgaaacgttaactgaaacgcatatttgcggattagttcatgactttatctctaacaaattgaaattaaacatttaattttattaaggcaattgtggcacaccccttgctttgtctttatcaacgcaaataacaagttgataacaaaggatgggctatgtctctacactctccaggtaaagcgtttcgcgctgcactgactaaagaaaatccattgcagattgttggcaccatcaacgctaatcatgcgctgttggcgcagcgtgccggatatcaggcaatttatctttctggcggtggcgtggcggcaggttcgctggggctgcccgatctcggtatttctacccttgatgatgtgctgaccgacattcgccgtatcaccgacgtttgttcgctgccgctgctggtggatgcggatatcggttttggttcttcggcctttaacgtggcgcgcaccgtgaaatcgatgattaaagccggtgcggcaggattgcatattgaagatcaggttggtgcgaaacgctgcggtcatcgtccgaataaagcgatcgtctcgaaagaagagatggtggatcggatccgcgcggcggtggatgcgaaaaccgatcctgattttgtgatcatggcgcgcaccgatgctctggcggtagaggggctggatgcggcgatcgagcgtgcgcaggcctatgttgaagcgggtgccgagatgttgttcccggaggcgattaccgaactcgccatgtaccgccagtttgccgatgcggtgcaggtgccgatcctcgccaacatcaccgaatttggtgccacgccgctgtttaccaccgacgaattacgcagcgcccatgtcgcaatggcgctgtacccactttcagcgttccgcgccatgaaccgcgccgctgaacatgtctacaacgtcctgcgccaggaaggcacgcagaaaagcgtcatcgacaccatgcagacccgcaacgagctgtacgaaagcatcaactactaccagtacgaagagaagctcgacaacctgtttgcccgtagccaggtgaaataaaaaacgcccgttgattgtattcgacagccgatgcctgatgcgtcgctgacgcgacttatcaggcctacgaggtgcactgaactgtaggtcggataagacggatggcgtcgcatccgacaaccgatgcctgatgcgccgctgacgtgacttatcaggcctacggggtgcactgaactgtaggtcggataagacgcatagcgtcgcatccgacaaccgatgcctgatgcgccgctgacgcgacttatcaggcctacggggtgcactgaactgtaggtcggataagacgcatagcgtcgcatccgacaaccgatgcctgatgcgccgctgacgcgacttatcaggcctacggggtgaactgaactgtaggtcggataagacgcatagcgtcgcatccgacaacaatctcgaccctacaaatgataacaatgacgaggacaacatgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaaacctctacgaataacaataaggaaacgtacccaatgtcagctcaaatcaacaacatccgcccggaatttgatcgtgaaatcgttgatatcgtcgattacgtcatgaactacgaaatcagctctaaagtggcctacgacaccgcacattactgcctgctcgacacgctcggctgcggtctggaagctctcgaatacccggcctgtaaaaaactgctggggccaattgttcccggcaccgtcgtacccaacggcgtgcgcgtccccggaactcagttccagctcgaccccgtccaggcggcatttaacatcggcgcgatgatccgctggctcgatttcaacgatacctggctggcggcggagtggggccatccttccgacaacctcggcggcattctggcaacggcggactggctttcgcgcaacgcggtcgccagcggcaaagcgccgttgaccatgaaacaggtgctgaccgcaatgatcaaagcccatgaaattcagggctgcatcgcgctggaaaactcctttaaccgcgtcggcctcgaccacgttctgttagtgaaagtggcttccaccgccgtggtcgccgaaatgctcggcctgacccgcgaggaaattctcaacgccgtttcgctggcgtgggtggacggtcagtcgctgcgcacctatcgccatgcgccgaacaccggcacgcgtaaatcctgggcggcgggcgatgccacttcccgcgcggtacgtctggcactgatggcgaaaacgggcgaaatgggttacccgtcagccctgactgcgccggtgtggggcttctacgacgtctcctttaaaggtgaatcgttccgcttccagcgcccgtacggttcctacgttatggaaaatgtgctgttcaaaatctccttcccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggcagaccgcgatcactgcattcagtacatggtggcgatcccgctgctattcgggcgcttaacggcggcagattacgaggacaacgttgcgcaagataaacgcattgacgccctgcgcgagaagatcaattgctttgaagatccggcatttaccgctgactaccacgacccggaaaaacgcgccatcgccaatgccattacccttgagttcaccgacggcacacgatttgaagaagtggtggtggagtaccccattggtcatgctcgccgccgtcaggatggtattccgaaactggtcgataaattcaaaatcaatctcgcgcgccagttcccgactcgccaacagcagcgcattctggaggtttctctcgacagagctcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgccatcgaccgctggctggagaaacagccagaggcgctggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcgcgcgcattggcgctattcactcggtggtgtttggtggatttgcctcgcacagcgtggcggcgcgaattgatgacgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcgcgcgtcagcgggcgggatgtcgatttcgcgtcgttgcgccatcaacacatcggcgcgcgggtaccggtggcgtggctggaatccaacgaaacctcctgcattctctacacttccggcacgaccggcaaacctaaaggcgtgcagcgtgacgtcggcggatatgcggtggcgctggcgacctcgatggacaccatttttggcggcaaagcgggcagcgtgttcttttgcgcatcggatatcggctgggtggtggggcattcgtatatcgtttacgcgccgctgctggcggggatggcgactatcgtttacgaaggattgccgacctggccggactgcggcgtgtggtggacaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggagatctgacgaccattgatgatcctgcgtcgttggatcagatccgccaggcgatggaagagtaggttattgtcggatgcgtcgcgcggtgcatccggcactgtgtgccgatgcctgatgcgacgctgacgcgttttatcatgcctacggacctgaaccgtaggtcggataaggcgctcgcgtcgcatccgacaccatgctcagatgcctgatgcgacgctgacgcgtcttatcaggcctacccactgtttttacaccgataatttttcccccacctttttgcactcattcatataaaaaatatatttccccacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttctcggttacattggcgcaaaaaccggcctgaccactcatcttcttgctcgcttctcgtttggtgttaaaggctcatggctgccttcactgctactgggcggaactcaggttggctggtttggcgtcggtgtggcgatgtttgccattccggtgggtaaggcaaccgggctggatattaatttgctgattgccgtttccggtttactgatgaccgtcaccgtcttttttggcatttcggcgctgacggttctttcggtgattgcggttccggctatcgcctgcctgggcggttattccgtgtggctggctgttaacggcatgggcggcctggacgcattaaaagcggtcgttcccgcacaaccgttagatttcaatgtcgcgctggcgctggttgtggggtcatttatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactgggcatggcggatatctctgatgtgatgattgctcagggcctgctgctgcctgcgattgtggtgctggggctgaatatctggaccaccaacgataacgcactctatgcgtcgggtttaggtttcgccaacattaccgggatgtcgagcaaaaccctttcggtaatcaacggtattatcggtacggtctgcgcattatggctgtataacaattttgtcggctggttgaccttcctttcggcagctattcctccagtgggtggcgtgatcatcgccgactatctgatgaaccgtcgccgctatgagcactttgcgaccacgcgtatgatgagtgtcaattgggtggcgattctggcggtcgccttggggattgctgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataacgctttacaaacaattattaacgcccggttaccaggcgaagaggggctgtggcagattcatctgcaggacggaaaaatcagcgccattgatgcgcaatccggcgtgatgcccataactgaaaacagcctggatgccgaacaaggtttagttataccgccgtttgtggagccacatattcacctggacaccacgcaaaccgccggacaaccgaactggaatcagtccggcacgctgtttgaaggcattgaacgctgggccgagcgcaaagcgttattaacccatgacgatgtgaaacaacgcgcatggcaaacgctgaaatggcagattgccaacggcattcagcatgtgcgtacccatgtcgatgtttcggatgcaacgctaactgcgctgaaagcaatgctggaagtgaagcaggaagtcgcgccgtggattgatctgcaaatcgtcgccttccctcaggaagggattttgtcgtatcccaacggtgaagcgttgctggaagaggcgttacgcttaggggcagatgtagtgggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccatgaaggcatgggcgcgcgagtcaccgccagccacaccacggcaatgcactcctataacggggcgtatacctcacgcctgttccgcttgctgaaaatgtccggtattaactttgtcgccaacccgctggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagttgatgggctacgggcagattaacgatggcctgaatttaatcacccaccacagcgcaaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacgttgaacgactgggttacagcgagcttagtttatgccggatgcggcgtgaacgccttatccggcctacgtagagcactgaactcgtaggcctgataagcgtagcgcatcaggcaattccagccgctgatctgtgtcagcggctaccgtgattcattcccgccaacaaccgcgcattcctccaacgccatgtgcaaaaatgccttcgcagcggctgtctgccagctgtagtttatgccggatgcggcgtgaacgccttatccggcctacgtagagcactgaactcgtaggcctgataagcgtagcgcatcaggcaattccagccgcagacctgtgtcagcggctaccgtgattcatttccgccaacaaccgcgcatttatccaacgccatgtgcaaaaatgccttcgcggcggctgtctgccagctatttttccgccgcaacaaaaccgccgttctctccagtagtggcggggcaagagaaatagctttaagcccgtcatgttgtgtggcaatcgctgctggtaacaatgtggaaagggaagtgcggcgaatcagctccagaaccgcgctaattgagttcgcctcaatgaccacctgtggatgtagccccgctttctcgcagtagtggtcaatttgctctctggtggcaaattccgcgctgagcaggaccagtttttcatcatgcaagcgactcaacgccacctgttcatggacggccagcggatgatgttgcgccacgactaacgctaaactttctgtcagtaaaggaattgcctccagctccggcgaatgcacaggcgcgaaggcaatcccaacgtccaactcgtcgcggcaaagcatatcctcgattttctcctgcgacatttcctgtagctggagcgtgatgctgggatagcgcgcatagaaatccgccattaaggggccgataaagtagctcgtaaaggtgggggtgacggcgatacgcagcgatcctcgcgtcagatcggcaacatcatgaatcgcccgtttacccgcccccagttcctgtaacgcccggctggcgtactgtcgccagacttctcctgcatcagtgagacgaatcgttcgcccgctacggtcaaacagcggcacgcctaaactctcctctaactggcgaatctgctgggaaagcgcaggttgggagacgtgcaacgcactggcggcacgggtgaagctgccatgttcagccacggcaagaaaataattgatatgtcgagagagcattcgcaacctataagtaaatccaatggaactcatcataaatgagacttttaccttatgacaatcggcgagtagtctgcctctcattccagagacagacagaggttaacggtgaaagagattattgatggattccttaaattccagcgcgaggcatttccgaagcgggaagccttgtttaaacagctggcgacacagcaaagcccgcgcacactttttatctcctgctccgacagccgtctggtccctgagctggtgacgcaacgtgagcctggcgatctgttcgttattcgcaacgcgggcaatatcgtcccttcctacgggccggaacccggtggcgtttctgcttcggtggagtatgccgtcgctgcgcttcgggtatctgacattgtgatttgtggtcattccaactgtggcgcgatgaccgccattgccagctgtcagtgcatggaccatatgcctgccgtctcccactggctgcgttatgccgattcagcccgcgtcgttaatgaggcgcgcccgcattccgatttaccgtcaaaagctgcggcgatggtacgtgaaaacgtcattgctcagttggctaatttgcaaactcatccatcggtgcgcctggcgctcgaagaggggcggatcgccctgcacggctgggtctacgacattgaaagcggcagcatcgcagcttttgacggcgcaacccgccagtttgtgccactggccgctaatcctcgcgtttgtgccataccgctacgccaaccgaccgcagcgtaaccttatttttaaaccatcaggagttccaccatgattcagtcacaaattaaccgcaatattcgtcttgatcttgccgatgccattttgctcagcaaagctaaaaaagatctctcatttgccgagattgccgacggcaccggtctggcagaagcctttgtaaccgcggctttgctgggtcagcaggcgcttcctgccgacgccgcccgcctggtcggggcgaagctggatctcgacgaagactccattctactgttgcagatgattccactgcgtggctgcattgatgaccgtattccaactgacccaacgatgtatcgtttctatgaaatgttgcaggtgtacggtacaaccctgaaagcgttggttcatgagaaatttggcgatggcattattagcgcgattaacttcaaactcgacgttaagaaagtggcggacccggaaggtggcgaacgtgcggtcatcaccttagatggtaaatatctgccgaccaaaccgttctgacagccatgcgcaaccatcaaaagacgttcacgatgctgctggtactggtgctgattggtcttaatatgcgaccactgctcacctccgtcgggccactgctaccgcaattgcgccaggcgagcggaatgagctttagcgtggctgccctgttgaccgctctgccggtggttaccatgggcgggctggcgctggccggaagctggcttcatcagcatgtcagcgaacgtcgcagtgtcgccatcagtctgttgctgattgccgtcggtgcattgatgcgtgagctttacccgcaaagtgcgctgctgcttagcagcgcactgcttggtggggtggggatcggcatcattcaggcggtgatgccttcggtgattaaacggcggtttcagcagcgcacgccactggtgatggggctgtggtccgcggctctgatgggcggcggtgggcttggtgccgccataacgccctggttagttcaacatagcgaaacctggtatcaaacactcgcctggtgggcgctgcctgccgttgttgcgctctttgcctggtggtggcaaagcgcccgcgaggtcgcctcttcccacaagacaacaaccactccggttcgcgtggtattcactccccgcgcgtggacgctgggtgtttacttcggtctgattaacggcggttacgccagcctgattgcctggttacccgctttctatattgagattggtgccagcgcgcagtacagcggttccttactggcattgatgacgcttgggcaagccgcaggagctttgctgatgcctgctatggctcgccatcaggatcggcgcaaactgttaatgctggcgctggtgttacaactggtggggttctgcggctttatctggctgccgatgcaattgccggtattgtgggcgatggtgtgtgggttaggtctgggcggcgcgtttccgctctgtttgctgctggcgctcgatcactctgtgcaaccggctattgctggcaagctggtggcgtttatgcagggaatcggttttatcatcgccgggcttgccccgtggttttctggcgtgctgcgtagtatcagcggcaattacctgatggactgggcatttcatgcgctgtgcgtcgttgggctgatgatcataaccctgcgttttgcaccagtacgttttccgcagctgtgggtcaaagaggcatgatgcgacgcttgttcctgcgctttgttcatgccggatgcggctaatgtagatcgctgaacttgtaggcctgataagcgcagcgtatcaggcaatttttataatttaaactgacgattcaactttataatctttgaaataatagtgcttatcccggtcgtttatttcgcgaataacccgacaaggaacgccagccgccacgacgtttggtggaatgtcttttgtgacgatactacccgcgccaataacagaattatccccgatggtgacgcctggattaataaccacatgacttccgatccagacgttattgccaatcgttatcggaaaagagtacatctcgccgttttttctcaattcatggtgtacagggtgtcccgtaacggaaagagtaacgttgggtgcaatcagtacgttatcaccgattgttaccgtgtagtcatcgacaatggttaaattgaaatttgcataaaaattgcggcctatatggatgttggaaccgtaagagaaatagacaggcggttctacccaggcgttttcccctaccgtggcaaacatttctttaatcaggctttctcttttttcaacttctgatggatgcgagtgattaaactcatacattaacgttttcccacgaagtcttttttccggtaagccttcgcacatatcggtaaatagcttgcctgctcttattctttcggtcattggcatgttcaatgcgatcactccgttatgatatgttggtcggataaggcgctcgcgccgcatccgacattgattgcttaagcgacttcattcacctgacgacgcagcagggaaagcgggccggggccgctaagcgtgaacacggaaattaaggtgaagcccagcgccaccagacccagcaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcgtttttcccaccgatgcgattaatgatcagtggcgcaaagaacataatcgaggcgttaagtaattcgcccattgtcgttacgtagccaaatacccgcgtaccctgttcaccggtagcaaagaacgaagtaaagaaattagcaaactgttggtcaaaaacatcgtaggtgcaggaaacgccaataacatacagtgacaaaaaccacagttttggctgtctgaacagttccagtgccagcttaaggctaaatgccgaatggttggcacctaccgcattggcaaccgtggcagaagagggcgcatccgttttggcgaaaaagagtaaaacggcgaggatgagtgcacagccagagcccagccagaaaacaaactgattattgatggtgaacatgatgccgacaatcgaggcacacagcgcccagccaacacagccaaacatccgcgcgcgaccaaattcgaaattactgcgacggctgactttctcaataaatgcctctactgctggcgcaccggcgttaaaacaaaagcctagataaataccaccaacaatcgatcctactaaaatgttgtattgtaacagtggcccgaagataaaaataaagaacggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggctcccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgctgttgactgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggcggcagtaaggcggtcgggatagttttcttgcggccctaatccgagccagtttacccgctctgctacctgcgccagctggcagttcaggccaatccgcgccggatgcggtgtatcgctcgccacttcaacatcaacggtaatcgccatttgaccactaccatcaatccggtaggttttccggctgataaataaggttttcccctgatgctgccacgcgtgagcggtcgtaatcagcaccgcatcagcaagtgtatctgccgtgcactgcaacaacgctgcttcggcctggtaatggcccgccgccttccagcgttcgacccaggcgttagggtcaatgcgggtcgcttcacttacgccaatgtcgttatccagcggtgcacgggtgaactgatcgcgcagcggcgtcagcagttgttttttatcgccaatccacatctgtgaaagaaagcctgactggcggttaaattgccaacgcttattacccagctcgatgcaaaaatccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtcggattctccgtgggaacaaacggcggattgaccgtaatgggataggtcacgttggtgtagatgggcgcatcgtaaccgtgcatctgccagtttgaggggacgacgacagtatcggcctcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaatccgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgcatgccgcttcgccttccggccaccagaatagcctgcgattcaaccccttcttcgatctgttttgctacccgttgtagcgccggaagatgcttttccgctgcctgttcaatggtcattgcgctcgccatatacaccagattcagacagccaatcacccgttgttcactgcgcagcggtacggcgatagaggcgatcttctcctcctgatcccagccgcggtagttctgtccgtaaccctctttgcgcgcgcgcgccagaatggcttccagctttaacggttcccgtgccagttgatagtcatcaccggggcgggaggctaacatttcgattaattccttgcggtcttgttccgggcaaaaggccagccaggtcaggcccgaggcggttttcagaagcggcaaacgtcgcccgaccattgcccggtgaaaggataagcggctgaaacggtgagtggtttcgcgtaccaccattgcatcaacatccagcgtggacacatctgtcggccataccacttcgcgcaacagatcgcccagcagtggggccgccagtgcagaaatccactgttcgtcacgaaatccttcgcttaattgccgcactttgatggtcagtcgaaaactatcatcggaggggctacggcggacatatccctcttcctgcagcgtctccagcagtcgccgcacagtggtgcgatgcaggccgctgagttccgccagcagcccgacgctggcaccgccatcaagtttatttaacatatttaataacattagaccgcgggttaagccgcgcacggttttgtattccgtctgctcattgttctgcatattaattgacatttctatagttaaaacaacgtggtgcacctggtgcacattcgggcatgttttgattgtagccgaaaacacccttcctatactgagcgcacaataaaaaatcatttacatgtttttaacaaaataagttgcgctgtactgtgcgcgcaacgacattttgtccgagtcgtgaggtactgaaatggcaatacaacaccctgacatccagcctgctgttaaccatagcgttcaggtggcgatcgctggtgccggcccggttgggctgatgatggcgaactatctcggccagatgggcattgacgtgctggtggtggagaaactcgataagttgatcgactacccgcgtgcgattggtattgatgacgaggcgctgcgcaccatgcagtcggtcggcctggtcgatgatgttctgccgcacactacgccgtggcacgcgatgcgttttctcaccccgaaaggccgctgttttgctgatattcagccaatgaccgatgaatttggctggccgcgccgtaacgcctttattcagccgcaggtcgatgcggtgatgctggaaggggtgtcgcgttttccgaatgtgcgctgcttgttttcccgcgagctggaggccttcagtcagcaagatgacgaagtgaccttgcacctgaaaacggcagaagggcagcgggaaatagtcaaagcccagtggctggtagcctgtgacggtggagcaagttttgtccgtcgcactctgaatgtgccgtttgaaggtaaaactgcgccaaatcagtggattgtggtagatatcgccaacgatccgttaagtacgccgcatatctatttgtgttgcgatccggtgcgcccgtatgtttctgccgcgctgcctcatgcggtacgtcgctttgaatttatggtgatgccgggagaaaccgaagagcagctgcgtgagccgcaaaatatgcgcaagctgttaagcaaagtgctgcctaatccggacaatgttgaattgattcgccagcgtgtctacacccacaacgcgcgactggcgcaacgtttccgtattgatcgcgtactgctggcgggcgatgccgcgcacatcatgccggtatggcaggggcagggctataacagtggtatgcgcgacgcctttaacctcgcatggaaactggcgttggttatccaggggaaagcccgcgatgcgctgctcgatacctatcaacaagaacgtcgcgatcacgccaaagcgatgattgacctgtccgtgacggcgggcaacgtgctggctccgccgaaacgctggcagggtacgttacgtgacggcgtttcctggctgttgaattatctgccgccagtaaaacgctacttcctcgaaatgcgcttcaagccgatgccgcaatattacggcggtgcgctgatgcgtgagggcgaagcgaagcactctccggtcggcaagatgtttattcagccgaaagtcacgctggaaaacggcgacgtgacgctgctcgataacgcgatcggcgcgaacttcgcggtaattggctggggatgcaatccactgtgggggatgagcgacgagcaaatccagcagtggcgcgcgttgggcacacgcttcattcaggtggtgccggaagtgcaaattcataccgcacaggataaccacgacggcgtactacgcgtgggcgatacgcaaggtcgcctgcgtagctggttcgcgcaacacaatgcttcgctggtggtgatgcgcccggatcgctttgttgccgccaccgccattccgcaaaccctgggcaagaccctgaataaactggcgtcggtgatgacgctgacccgccctgatgccgacgtttctgtcgaaaaggtagcctgatatgcacgcttatcttcactgtctttcccactcgccgctggtggggtatgtcgacccggcgcaagaggtgctcgatgaggtcaatggcgtgattgccagcgcccgcgagcgtattgcggcattctcccctgaactggtggtgctgtttgcgccagatcactacaacggctttttctatgacgtgatgccaccgttctgtttaggcgttggagcgacggcaattggtgatttcggcagtgcggcaggagagctgcccgtgcctgtggagctggcggaggcctgtgcgcatgccgtcatgaagagcgggatcgatcttgccgtttcttactgtatgcaggtggaccacgggttcgcccagccgctggagttcctgctcggtgggctggataaggtgccagttctgcctgtgttcatcaacggtgtcgccacgccgctgcccggtttccagcgtacccgcatgttgggtgaagccattggacgtttcaccagcactctcaataaacgcgtgctgttcctgggttccggtgggctttcccatcagccgccggtgcccgaactggcgaaagccgatgcccatatgcgcgaccgtctgttggggagcgggaaagatttacccgccagtgagcgcgaattgcgtcagcaacgggtgattagcgccgctgagaagtttgttgaggatcagagaacgctgcatccgctcaacccgatttgggataaccagttcatgactttgctggagcagggacgcatacaggaactggatgccgtcagtaacgaagagctttccgccattgccggaaagtcgacacatgaaatcaaaacctgggtcgccgcttttgccgctatttctgcgtttggcaactggcgtagcgaagggcgttattaccgcccaatcccggagtggattgccggatttggctcgttaagcgccagaacagagaactgaatatgcaggagaagatgatgagttatcagccacaaaccgaagccgccaccagccgttttctgaatgtagaagaagcgggtaaaacgctgcgcatccattttaatgactgcggacaaggcgacgaaaccgttgtcctgctgcatggttccggcccgggtgctactggctgggcgaacttcagccgcaatatcgatccgctggtagaggcgggctatcgggtgatcctgctggattgtccgggttggggcaagagcgattcggtcgttaatagtggttcgcgatcggatcttaatgcacgaatcctgaaaagcgtggtggatcaactggatatcgccaaaatccacctgctgggcaactcgatggggggccatagttctgtggcgttcacccttaaatggccggagcgcgtcggcaaactggtgctgatgggcggcggtacgggcggcatgagtttgtttacgccgatgccaaccgaaggtattaagcgactgaatcagctttatcgtcagccgactatcgaaaacctgaagctgatgatggatatcttcgtttttgataccagcgatttgaccgacgccctgtttgaagcgcgcctgaataatatgctgtcgcgccgcgatcacctggaaaacttcgttaagagcctggaagctaatccgaaacagttcccggattttggcccacgtctggcggaaatcaaagcgcaaaccctgattgtctgggggcgcaacgaccgctttgtgccgatggatgcgggtctgcgtctgctgtccggcattgccggttctgaactgcatatcttccgcgactgtggtcactgggcgcagtgggaacatgccgacgctttcaatcaactggtgctgaatttcctcgcacgcccttaaggaatggtcatgacgaagcatactcttgagcaactggcggcggatttacgccgcgccgcagagcagggcgaagcgattgcaccgctgcgcgatctgattggtatcgataacgctgaagcggcttacgccattcagcacataaatgtgcaacatgacgttgcgcaggggcgtcgcgtggtagggcgtaaagtgggcctgacacatccgaaagtgcaacaacaactgggcgttgatcaaccggattttgggacgttatttgccgacatgtgttatggcgataacgaaatcattcctttttcccgtgttctgcaaccccgcattgaagcggagatcgcactggtgttgaaccgcgatttgcccgcaaccgatatcaccttcgacgaattgtataacgccattgaatgggtacttccggcgctggaagtggtggggagccgcattcgcgactggtcgattcagtttgtcgataccgtggcagataacgcctcctgtggggtgtatgtcatcggcggtccggcgcaacgtccggcggggttagacctgaaaaactgcgccatgaagatgacgcgtaataacgaagaggtttctagcgggcgcggcagcgaatgcctgggacatccgcttaatgcggccgtctggctggcacgcaaaatggccagtctgggtgaaccgctgcgcaccggagatatcattcttaccggggcattaggtccgatggtggcggtgaatgcgggcgatcgttttgaagcccatattgaaggcataggttcagttgctgcgacattttcaagcgcagccccaaaaggaagtctgtcatgagtaagcgtaaagtcgccattatcggttctggcaacattggtaccgatctgatgattaaaattttgcgtcacggtcagcatctggagatggcggtgatggttggcattgatcctcagtccgacggtctggcgcgcgccagacgtatgggcgtcgccaccacccatgaaggggtgatcggactgatgaacatgcctgaatttgctgatatcgacattgtatttgatgcgaccagcgccggtgctcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtggggcaattctccggactgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatgaacggtaaaaaactttatatctcggacgtcacattgcgtgacggtatgcacgccattcgtcatcagtattcgctggaaaacgttcgccagattgccaaagcactggacgatgcccgcgtggattcgattgaagtggcccacggcgacggtttgcaaggttccagctttaactatggtttcggcgcacatagcgaccttgaatggattgaagcggcggcggatgtggtgaagcacgccaaaatcgcgacgttgttgctgccaggaatcggcactattcacgatctgaaaaatgcctggcaggctggcgcgcgggtggttcgtgtggcaacgcactgtaccgaagctgatgtttccgcccagcatattcagtatgcccgcgagctcggaatggacaccgttggttttctgatgatgagccatatgaccacgccggagaatctcgccaagcaggcaaagctgatggaaggctacggtgcgacctgtatttatgtggtggattctggcggtgcgatgaacatgagcgatatccgtgaccgtttccgcgccctgaaagcagagctgaaaccagaaacgcaaactggcatgcacgctcaccataacctgagtcttggcgtggcgaactctatcgcggcggtggaagagggctgcgaccgaatcgacgccagcctcgcgggaatgggcgcgggcgcaggtaacgcaccgctggaagtgtttattgccgccgcggataaactgggctggcagcatgggaccgatctctatgcgttaatggatgccgccgacgacctggtgcgtccgttgcaggatcgaccggtacgagtcgatcgcgaaacgctggcgctgggatacgctggtgtttactcgagcttcctgcgtcactgtgaaacggcggcggcgcgttatggcttaagtgcggtggatattctcgttgagctgggcaaacgccggatggttggcggccaggaggatatgatcgttgacgtggcgctggatctgcgcaacaacaaataatgatgactgccgagaacgtgcattttgtatgcccatcccagcacgactgccggatgcggcgtgaacgccttatccggcctacggatggcgtgagaatttgtaggtctgataagacgcgttagcgtcgcatcaggcatctgcgcacgactgccggatgcggcgtgaacgccttatccggcctacggatggcgcgggaatttgtaggcctgataagacgcgttagcgtcgcatcaggcatctgcgcacgactgccggatgcggcgtgaacgccttatccggcctacgggtggcgcgagaatttgtaggcctgataagacgcgttagcgtcgcatcaggcatctgcgcacgactgccggatgcggcgtaaacgccttatccggcctacggatggcgcgggaatttgtaggcctgataagacgcgttagcgtcgcatcaggcatctgcacacgactgccggatgcgataaacgtcttgtccggcctacatttcgcccgtaggcagtcattaaatagttctgattacgcggctggcaatgtatcagtcgcgattcacctgcactcgcaacgaggttcatcttatgtcgactcgtaccccttcatcatcttcatcccgcctgatgctgaccatcgggctttgttttttggtcgctctgatggaagggctggatcttcaggcggctggcattgcggcgggtggcatcgcccaggctttcgcactcgataaaatgcaaatgggctggatatttagcgccggaatactcggtttgctacccggcgcgttggttggcggaatgctggcggaccgttatggtcgcaagcgcattttgattggctcagttgcgctgtttggtttgttctcactggcaacggcgattgcctgggatttcccctcactggtctttgcgcggctgatgaccggtgtcgggctgggggcggcgttgccgaatcttatcgccctgacgtctgaagccgcgggtccacgttttcgtgggacggcagtgagcctgatgtattgcggtgttcccattggcgcggcgctggcggcgacactgggtttcgcgggggcaaacttagcatggcaaacggtgttttgggtaggtggtgtggtgccgttgattctggtgccgctattaatgcgctggctgccggagtcggcggttttcgctggcgaaaaacagtctgcgccaccactgcgtgccttatttgcgccagaaacggcaaccgcgacgctgctgctgtggttgtgttatttcttcactctgctggtggtctacatgttgatcaactggctaccgctacttttggtggagcaaggattccagccatcgcaggcggcaggggtgatgtttgccctgcaaatgggggcggcaagcgggacgttaatgttgggcgcattgatggataagctgcgtccagtaaccatgtcgctactgatttatagcggcatgttagcttcgctgctggcgcttggaacggtgtcgtcatttaacggtatgttgctggcgggatttgtcgcggggttgtttgcgacaggtgggcaaagcgttttgtatgccctggcaccgttgttttacagttcgcagatccgcgcaacaggtgtgggaacagccgtggcggtagggcgtctgggggctatgagcggtccgttactggccgggaaaatgctggcattaggcactggcacggtcggcgtaatggccgcttctgcaccgggtattcttgttgctgggttggcggtgtttattttgatgagccggagatcacgaatacagccgtgcgccgatgcctgacgtgccttattaggcaggggcgaaagggacttcaccccaatacacctacggcgtttacaggtatactcgctaaaaattattcagcgggtttggaaacaaagatggcaaaacttaccttacaagagcagttgctcaaagcaggattagtcaccagcaaaaaagcggcgaaggtggagagaacggcgaaaaaatcgcgcgttcaggcgcgtgaagctcgggcggcggtagaagaaaataaaaaggcacagcttgagcgtgataaacagcttagcgaacagcaaaaacaagcggcgttggcgaaagaatataaagctcaggtgaagcagcttattgaaatgaaccgaatcaccattgccaatggcgatattggttttaacttcactgacggcaatctgattaagaagatttttgtcgataagctcacacaggcgcagttgattaatggtcgtctggcgattgcccgcttgttggtcgataacaatagcgaaggtgaatacgccattattcccgccagcgttgccgataaaattgctcagcgcgatgccagcagtatagtgttgcacagcgcgctcagcgccgaagagcaggatgaagacgacccgtatgccgacttcaaagtgcctgatgatttgatgtggtaaacatagataagtcgtgcgcagatgcctgatgcgacgctatgcgcgtcttatcaggcctacggtttatgggcgaagtgtagaccggataaggcgttcacgccgcatccggcagtcgtgcgccatgcctgatgcgacgctttgcgcgtcttatcaggcctacggcttacgggcgaagtgtaggccggataaggcgttcacgccgcatccggcagtcgtgctattatcaacgcatattcagtttattggcgtggtaggcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaacccctgatcaaccatgatttccgcaacgcgttgaccttgtgaaataagactcaccgggtcgtaatccaaccaggcatctttattttcagcaagatatgcagcaaaggcttgctgtccccacggcacttgcgatggggagacaatgggcgaaaacgccgagacgctgacatattcatctgggttacgtaacgccagcaccagcgcgcccagcccgcccatagaatgaccagagatagactttttggccgttgccggaaaatgatgcatcactaaatccggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacagcaccggcaatttttcattcgcggcttttggtgggagatagacgccgacattcatttcacatttcagtgattgggaataatgccgatacatattttgccagccgccaaagctgacatgtttttcaatgagttccatcagtcattatctcagggttaatcccccggacggctgcccggggagagtattaagaacccccgcctgaagtggacggggtaaacctgcgggaaatcagtaacgaattacggttcgaatggatttgccttcatgcatcaggtcgaaggcgtcattaatttcatccaggctcatggtatgcgtgacaaacggttccagatcgatatcacctttcatcgcatcttcaaccatgcccggtaactgggaacgacctttcacgccgccaaacgcggaacctttccatacgcgaccagtgaccaactggaatggacgggtggagatttcctgaccggcaaccgcgaccccgatgatcaccgactgaccccagccgcggtgcgcactttccagcgccgcacgcatcacgttgacgttaccgatgcattcaaaggtatggtcgataccccatttgttgatatccaacaggacatcttttatcggtttgtcgtagtcattcgggttaatgcagtcggtagcaccgaagcgacgcgccagatcgaatttcttcgggttggtatcgatagcgataatccgacccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaatttttgccagagacacttccgcgactacggtgtattcactgaatgtagagcaccccatgtagtgataaagcggctgcccgttgtaagaaaaacgggtggtgccgtctggcatcaggcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatcgccggagagggtaaatgcgtcggtatggcaaacgccggtatgggtgactttaattagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagcccattagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcatgcaatatactataggggggtattctatatgtcaatgcatacccccctatagtatataacactggagaataaaatttatccggtgaatgtggtcggaaaacaaagaggaaaggggggggggctaatcggcagggaaggccgccccggatagcgggcggcagaaggaatcagaatttccaggtcagacgggctgcaagttgcagaccgttaaaatcatcggttggggtgtcgtaccacactttacctgccgtcagcccgagattaagttgctcagtcagcggttgaatacgttgcagactgacgctcttcatgctgccgtagcgtgtttctggcgtccagtcataggtgtaagcacctgttccgcggcttagccatagttgcgtataaccagtgccgcgcgggtcattcagacgcacggaaatcatattgctataactaccacctgcatcgctggagtcataatgggtatagcggtagctggtgatcaccgggccagtatagagtgatacgccgccttgccaggcatcgacttcgacatcatcgtaatatttagtgtagcgataaccggtcgtgaaaagcgtttttggtaacagggccaggttaatatcctgacgaaaatcctggcgggcaaagaccggcgtattatccgcaaaggcaatacccgttcgggttgtcagccagttattccatttataccagaccgcaccctgaccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataagcgggcaatgcgctaaaaatggccgccgctaataacgtccgttttatcattttaatctcctgtacggataagttcttgtcggagtgaataagttccggtaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccctctggagttcgaacagacacgggctgttcatccagacgatgattactggtacgtacttgtgcgcctaaatatgcctggtttgcaactaccgagtcggcaataaaacattgcggaccaatcgttgcttccgcttcaataaccgcatttttaatctcggtggcaaaaccaatttttacgccattgctgattattgtgccaggacgaataaacgcataattactagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaattacctatcaggcagtttgcgccaatcactaccggaccctgaataacggcaccatgacaaatacgggtattcgcgccgataacaacttcacctgcagtttcatcaataattacctggtctgcaatctgaatatttttctctttaacattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggcgctaaaggcaccaacaaccagcaacgatgaaaccaggcgctaaaagcaccaataacacaaactacgccgacccagataagcggaaacattgccaacaccactccatgcggcccggtggtgatgaattcattaaaccaggtagtgagataaatcccaacgccataaagcacaaccaacagcataggaaatatactgaagataccgaagcggctaaataaaagtcttttatgcaggcgcatacagaccgcgtatcccacaatccaacgccgccagcgacgccactcctcacgcgggctgttgcattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgataataaacggtgcgccacccaggagctgctgtagcgtgcgcttcataacaatcatcggcaactttacggtcgcgcggatgtgcggtaacagacccgcgcctttcaacgcagtagagggaatgccgcctacggcatcggcaccgcgctcaatttctgccagcatatagcccattccgtcttgatcgggcggaacataggtgtcggcatcacttaaaaaaacctggtcgcaggtggcgtaattgaggccattcatcagcgcaccacctttaccggtatttttttgcgtgacggcaacaaagcggtcgccccatttgcgtttgacttccgccatgaccgcttcggtattgtccgtggagccgtcgttaacgcaaattacccggcaaaaataagggttacgcagtagattatccagtgactgcgccagacacgggccttcgttatacgcaggtataatggcgtcaatacagcctttcttttgactgggtttacgtcttagcgtacttaaaaaccatagcaacattgctatggacatacagataaatatccaggttttcatgcaatttgctcaaagaatcattttatgaattacaaagccttcacccagatcgctattgacctgttgtccgcgaaattgtgcaactgcacgcaggcgatcatgacgcatataatcgcgtcgttcctagcttttatgtttttttaatgcagcaagtttgactgtgaaatattcttctttaacggattcaaaaacctgaggcataaatgaaagccaggtacttggggtttcgtagccgagaatttgcggaatagttcggcaggcaaccattgaagcttgataaacagcaagatgatcctgatggcggtcggcatcatgcatggtatatacccgcatgatttcaacatcagaaggaatttgatttttaatgatgtcttccagggcggaaatcatatcattgagctgtaaatgagcgcgggtgtcagcaaaattaagatgaatagtttggtggcaccctaatatctttagggcgttgcgcgattcttcatggcgatcgattattccatctgtgccagagttgccggtagtcatcaccacggctgcgatataaattcctttttgcgcaagacgagcaagcgatgcgccacagcctaattctatatcgtcaggatgtgcgccaatagcaaggataccctttcttttatttgccgaagaaaggagggctgaatctaaaaccttatccacttaatgacactccattttatttattatactacaagcacaacgatgcactcagagacgtaatctctggcgcagccagatgttaatttataaatgttaaatgttgctaataactgaaaagcaagggctttcagacccgtgggttcgactgggtaatgtttctatgcaattcatatgttaagtgtttgtatgtttggtatgtatagttattttgttttatacattgtatttagatgtgatttagtttgtcaattaattgcatttaaaaaatatgttctgtgaacaagcattgtttatatacattatgtgaatgtaatatgcgagtgattgagaatgatacagtgatatatacaatgcgaatataatagttttattatatgtattgatattgatagaaataatgaagtaataaatctcgtaatgtggttgtttatgcatcactaaaatgaagtgtagtaattttcccaattgttagaacggagtaattgcatatttaatctttccttagccgtttttttgctaagaataaaatcatctgtgcgataacgactaattcttttaatgaatgtttttattcctgaatactgctcccataacaagacaggggagcagacaatcatggcaatttcatcgcgtaacacacttcttgccgcactggcattcatcgcttttcaggcacaggcggtgaacgtcaccgtggcgtatcaaacctcagccgaaccggcgaaagtggctcaggccgacaacacctttgctaaagaaagcggagcaaccgtggactggcgtaagtttgacagcggagccagcatcgtgcgggcgctggcttcaggcgacgtgcaaatcggcaacctcggttccagcccgttagcggttgcagccagccaacaggtgccgattgaagtcttcttgctggcgtcaaaactgggtaactccgaagcgctggtggtaaagaaaactatcagcaaaccggaagatctgattggcaaacgcatcgccgtaccgtttatctccaccacccactacagcctgctggcggcactgaaacactggggcattaaacccgggcaagtggagattgtgaacctgcagccgcccgcgattatcgctgcctggcagcggggagatattgatggtgcttatgtctgggcaccggcggttaacgccctggaaaaagacggcaaggtgttgaccgattctgaacaggtcgggcagtggggcgcgccaacgctggacgtctgggtggtgcgcaaagattttgccgagaaacatcctgaggtcgtgaaagcgttcgctaaaagcgccatcgatgctcagcaaccgtacattgctaacccagacgtgtggctgaaacagccggaaaacatcagcaaactggcgcgtttaagcggcgtgcctgaaggtgacgttccggggctggtgaaggggaatacctatctgacgccgcagcaacaaacggcagaactgaccggaccggtgaacaaagcgatcatcgacaccgcgcagtttttgaaagagcagggcaaggtcccggctgtagcgaatgattacagccagtacgttacctcgcgcttcgtgcaataaaaggaggcgcagatgctgcaaatctctcatctttacgccgattatggcggcaaaccggcactggaagatatcaacctgacgctggaaagcggcgagctactggtggtgctggggccgtccggctgcggtaaaaccaccctgctgaatctgattgccggttttgtgccttatcagcatggcagcattcaactggcgggtaagcgtattgagggaccgggagcagagcgtggcgtagtttttcagaatgaagggctactaccgtggcgcaatgtacaggacaacgtggcgttcggcctgcaattggcaggtatagagaaaatgcagcgactggaaatcgcgcaccagatgctgaaaaaagtggggctggaaggcgcagaaaaacgctacatctggcagctttccggtggtcaacgtcagcgggtggggattgctcgtgcgctggcggcgaatccccagctgttattactcgacgaaccgtttggtgcgctggacgccttcacccgcgaccagatgcaaaccctgctgctgaaactctggcaggagacgggcaagcaggtgctgttgattacccacgatatagaagaagcggtgtttatggcgactgaactggttctgctttcatccggccctggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcggcggctgaaatggcgctggccgctctcgcgtcaggtgaccttaagcattggcacgttagcggttttactcaccgtatggtggacggtggcgacgctgcaactgattagcccgctatttttgccgccgccgcaacaggtactggaaaaactactcaccattgccggaccgcaaggctttatggacgccacgctgtggcagcatctggcagccagtctgacgcgcattatgctggcgctatttgcagcggtgttgttcggtattccggtcgggatcgcgatgggacttagccctacggtacgcggcattctggatccgataatcgagctttatcgtccggtgccgccgctggcttatttgccgctgatggtgatctggtttggtattggtgaaacctcgaagatcttactgatctatttagcgatttttgcaccggtggcgatgtcggcgctggcgggggtgaaaagcgtgcagcaggttcgcattcgtgccgcccagtcgctgggtgccagccgtgcgcaggtgctgtggtttgtcattttgcccggtgcgctgccggaaatcctcaccggattacgtattggtctgggggtgggctggtctacgctggtggcggcggagctgattgccgcgacgcgcggtttaggatttatggttcagtcagcgggtgaatttctcgcaactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatatcggcgcacaaatttcgggtgccgacctgacgcgcccgttaagcgataatcagtttgaacagctttaccatgcggtgctgcgccatcaggtggtgtttctacgcgatcaagctattacgccgcagcagcaacgcgcgctggcccagcgttttggcgaattgcatattcaccctgtttacccgcatgccgaaggggttgacgagatcatcgtgctggatacccataacgataatccgccagataacgacaactggcataccgatgtgacatttattgaaacgccacccgcaggggcgattctggcagctaaagagttaccttcgaccggcggtgatacgctctggaccagcggtattgcggcctatgaggcgctctctgttcccttccgccagctgctgagtgggctgcgtgcggagcatgatttccgtaaatcgttcccggaatacaaataccgcaaaaccgaggaggaacatcaacgctggcgcgaggcggtcgcgaaaaacccgccgttgctacatccggtggtgcgaacgcatccggtgagcggtaaacaggcgctgtttgtgaatgaaggctttactacgcgaattgttgatgtgagcgagaaagagagcgaagccttgttaagttttttgtttgcccatatcaccaaaccggagtttcaggtgcgctggcgctggcaaccaaatgatattgcgatttgggataaccgcgtgacccagcactatgccaatgccgattacctgccacagcgacggataatgcatcgggcgacgatccttggggataaaccgttttatcgggcggggtaatacgagagtggacggtcccctcgcccccttggggagagggttagggtgagggggcgttcaccgtactttcaacaggttaactccccctttctgagaggaaacaaaattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcatactcaccgctcacctgatacgcgccaatcggcaattcagtacgttcacgcagctcacgcacgatgtcgaggtacgctccagcaggtttaaccatcaggcagtctgcgccctgggcttcatccagcagtgattcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaatcccgcagcgtccagcgcctgacgaatcgcctgtacctggccgtccatcgcggcggaaggggcgatgaagtctgcacctgcagcagctgcaaccacggcttgcttgcctaaattttccagagtcgcgtcgttgtcgacgccatgctcgcacagcacaccgcagtgaccgtgagaagtgtattcacagaagcaggtgtctgacataacgatcatttctggcacggtctgcttgcagatgcgcgacatacgcgccaccagtccatcttcccgccaggcatcgctgccggtttcatcggtatggtgagagatgccaaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaagtctgtcatggtctgcctgatgtttgtggaatcgaggggcatagtatacctgaagcagggtagggatgttttacgaaagttgtcgcgatgttgacaagaagagaatggaagagaggccaggacatctttttaatagaaacagcaataattttatattcactgaaaatatttttaatctttatttatagctgttggttattattttttggagtttggttgcgctgctataaattgaataattaaaactttgttgcatattcataggatatttatctggtttgtgtttgtgatatttattatgcgtatgcttcaaaaacaaaattatctgcaacatgttgaaatactgtgcttttatgaatttgatgcgtgtttttctccataaattatatatgtccacattcggacttaggggaaagaataattgaaccattcgtctgtaacgcagcataatcgttagcgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcagcaaactatgatacctggacttatatcgataatcccgttacagcacttgattgggatcatatggataaggcaggcactgtagatggcaactatgtaaactatagtggttttgtctattacaacaacaccaatggtgatttcgatcagtcctttaacggcgataccgttaacggcacgatctcaacctattatttgaaccatgattatgcagacagtactgctaatcagcttgatatcagtaattcagtgattcacggttcgattacttctatgctgcctggcggttattatgatcgttttgatgcagatggtaataatctgggtggatatgatttttacactgatgcggttgttgatacacactggcgtgatggtgatgttttcactttgaacattgctaacactactattgatgatgattatgaagctctttacttcactgattcttataaagatggtgatgtaaccaagcacacaaatgagacatttgatacaagtgaaggcgttgctgttaatcttgatgtagaaagtaacatcaatatttccaataactcccgcgttgcaggtattgcattatctcaaggtaatacttacaacgaaacctacactaccgaatctcatacttgggataacaatatctctgtaaaagattccacagtgacttcgggttcaaattatatcctggatagcaatacttatggcaaaactggtcactttggcaattctgatgaaccgagtgattatgctggcccgggtgatgttgcaatgtcctttactgcttcaggttccgactatgcgatgaagaacaatgtattcctcagcaattcaacgctgatgggtgatgttgcctttaccagcacctggaatagtaattttgatccgaatggtcatgattccaacggtgacggggtgaaagataccaacgggggttggactgatgatagcctcaacgttgatgaactaaatctcactctcgataacggaagcaagtgggttggtcaggcaatttataacgttgctgaaacgtcagcaatgtatgatgttgctacaaacagccttactcctgatgcaacatatgaaaacaatgactggaaacgtgttgttgatgacaaggtcttccagagcggtgtatttaacgtagcgttgaataacggttctgaatgggatactacaggtcgttccatcgttgataccttgacagttaataatggttctcaggttaatgtttcggaatctaaattaacttcagatactatcgatttaactaacggttcttcgctgaacattggtgaagatggctacgttgataccgatcatctgactattaactcctacagtactgttgcgttgaccgaatctactgggtggggggctgattgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagattacaacctgtacgccaatactatcaccgtaactaacggcggtgtattggatgtgaacgttgatcagttcgatactgaagctttccgtactgacaaactggaactgaccagcggcaacatcgctgaccataacggtaacgtagtatctggtgtgttcgatatccatagcagcgattacgttctgaacgctgatctggtgaacgaccgtacctgggatacttccaagtctaactacggttacggtattgttgctatgaactctgatggtcacctgactatcaacggtaacggcgacgtagacaacggtactgaactggataacagctctgtagacaatgttgttgctgcaaccggtaactacaaagttcgtatcgacaacgcaactggcgctggcgctatcgctgattacaaagataaagaaattatctacgtaaacgacgtcaacagcaacgcgaccttctctgctgctaacaaagctgacctgggtgcatacacctatcaggctgaacagcgcggtaacaccgttgttctgcaacagatggagctgaccgactacgctaacatggcgctgagcatcccgtctgcgaacaccaatatctggaacctggaacaagacaccgttggtactcgtctgaccaactctcgtcatggcctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgacatgaatgaccgttctggtcaggtggatcaagacagccagactgcctacatctactcttctgctcacttcgcgaacaacgtctttgttgatggtagcttgagctactctcacttcaacaacgacctgtctgcaaccatgagcaacggtacttacgttgacggtagcaccaactccgacgcttggggcttcggtttgaaagccggttacgacttcaaactgggtgatgctggttacgtgactccttacggcagcgtttctggtctgttccagtctggtgatgactaccagctgagcaacgacatgaaagttgacggtcagtcttacgacagcatgcgttatgaactgggtgtagatgcaggttataccttcacctacagcgaagatcaggctctgactccgtacttcaaactggcttacgtctacgacgactctaacaacgataacgatgtgaacggcgattccatcgataacggtactgaagggtctgcggtacgtgttggtctgggtactcagtttagcttcaccaagaacttcagcgcctataccgatgctaactacctcggtggtggtgacgtagatcaagactggtccgcgaacgtgggtgttaaatatacctggtaatattcttcactccgaagaaatactggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtgatgtcaataacgaagatactttcgttattttagagggagttatctctctgcgtagagaagaaaacgtacttatcggtattacccaggctccttatattatggggctggctgatggtttaatgaaaaacgatataccatacaaattaatatcagaaggaaattgtacgggatatcatctaccagccaaacaaaccattacgcttattgaacaaaatcaactctggcgagacgctttttactggttagcctggcaaaatagaattctggaattacgcgacgtgcagctcattgggcataattcctacgaacaaatccgcgcaacattattatcaatgattgactggaatgaagaattgcgatcacgtattggtgtgatgaattatatccatcaacgtacacgcatatcgcgttctgtcgtcgcagaagttctcgctgctttgcgtaaaggcggctatatcgaaatgaataaaggcaaactggtcgctatcaaccgtttgccttcagagtattaatcaggacgcggggataaccaacggtttattcccgcttagctcggtcaccaggtcattgatgccatcgctcatatttttaaagcgcgtcaacggcgaacgagtgaccaccacaaacgcgccaatattcttctgcgggatcatcgccatataggtaatgaaaccgccaccaccgcctgtcttctgaataatccccggacgaccctctttcggggccatatatacccaacctaaaccaagcgcatccgctttgccggggacatccatgccaatcactttcgtaaactgcgcgcgctgataaatcaacgtctgcatgcgatctgcctggttactgcgctgataaaaatcagatgacaaatactgctgcatccagcgcatcatatcgccaggcgtggaatagacgccgccgctgccaattgccgccagcgtgttattgcacggactggcaccgcgctcagcaaccattaaacggcggcactgatccggtgagggggtgtaggtggtgtctttcatccccaatggacgggtaatctgctcttcaaacaactgggtataaggcttgccggacgcattcgccagtgcatctgccagcaggtcgaacgcaaggttagagtacgccgcctgactgcctggcgcggctttcagcttcgccgtagaaaggtatttccagcgttgctcgcgcgttggccagacaaacaccggacgatgtgccgcgccaccgggctgttcacggggcagggcgctggtatgggttgccagattgaccagcgtaatgggcgtcccattgtaggttggcacgcgtgcgcctggcggagcatatttacttagcggatcgtttaacttcacggtcccctggtcgagcaatttcaccagcatctcactggtcattagcttggtgagggaagcaatacgcacgaccgaatccagctgcgggcgaacgttattaccaggtcgcgtttcgccataactgcgaaagacgcgctggttaccgtcgataacaaccagagccatccccgtggcaccgctgccgtaaaaaatatgatcggcataacgatcgacaatatcagaggcaaactccggttcagtgatcggctgcgccgcatggacggaggtcaatgacgccgcacacagcacggcagaaaaaagcagactacgtttcaacggtggtgtccatagattgaatgaaggtaactgagcgtatttatactactcattgatagattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaatccgtcgaaacaattcttatggtcaggctggcgaactaagcgccttgctatgggtcacaatgggcggtttcatttggctgacgctttgtagcggtcatgcggttaatacacagcagttgttaaaacgataagaagttagcaggagtgcatatgtttaagtcttttttcccaaagccgggaacgttttttctctcggccttcgtttgggcattgattgccgttatcttctggcaagccggtgggggtgactgggtggcgcgtatcaccggcgcttccgggcagatcccgattagcgccgcgcgtttctggtcgttggatttcctgattttttacgcttactacattgtttgcgtaggactttttgcattgttctggtttatctacagcccgcatcgttggcaatactggtcaatactcggtactgcactgatcatcttcgtcacctggtttttggtggaagtcggggtcgccgtcaacgcctggtatgcgccgttctatgatctgattcaaaccgcgctaagttcgccgcataaagtcaccatcgaacaattttaccgcgaagtgggcgtctttctggggattgcgctgatcgctgtggtgatcagtgtgctgaacaacttctttgtcagtcactacgtgttccgctggcgtacagcgatgaacgaatattacatggcgaactggcaacaactgcgtcatatcgaaggggccgcacagcgtgtgcaggaagacaccatgcgttttgcttcaacgctggagaatatgggcgtcagttttatcaacgccatcatgacgttgatcgccttcctgccggtgctggtaacgctctccgcgcatgtgccggagctgccgattatcgggcacattccgtatggtctggtgattgccgcaatcgtctggtcgctgatggggaccggattgctggcagtggtagggatcaaactgccggggctggagtttaaaaaccagcgtgtagaggctgcctaccgtaaagagctggtttatggtgaagacgatgccacgcgcgcgacgccgcctacggtacgcgagctgtttagcgccgtacggaaaaactatttccgcctctattttcactatatgtatttcaacatcgcccgcattctctatttgcaggtcgataacgttttcggtttgttcttgctgtttccgtcaattgttgccggtacgattacgctcggcctgatgacgcagattaccaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcctctatcttcgctgtcattgttggcggttctggttttagcggggtgtagtagtcaggctccgcaaccgttgaaaaagggcgaaaaagcgatagatgtagcgagcgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggttcataccgcgctaaaaatcaaatcgccaaacggcaaaagttatagcgaacggttagattcggtgcgtacagaaaagcaattgagcgcgatttttgacgatctgatcaacatggtgccaatggggcagacgctgtttggttcgctcaatccggtgcgcaccggtgggccgatgcaggtcagcattgcttttgccgaacagcataccaaagggtatccgtggaaaatggacggtacagtccgtcaggaagtcttcagtcgccgcggcgggttgtggtttggtacttaccatttactgaattatcccgccagttatagcgcaccgatataccgttttgctgattttaacgctggctggtacgccagccgtaatgccgcgtttcagaacgcggtcagtaaggccagcggcgtgaagctggcactggacggtgatttaattcgttacgacagtaaagaacccgggaaaaccgaactggcaacgcgcaaactggctgcaaaactggggatgagcgacagcgaaattcgccgtcagttagagaaaggtgacagcttctcttttgaggagacggcgctgtacaagaaagtttatcaacttgccgaaacgaaaacgggtaaatcactcccccgcgaaatgttgcctggcattcaactggaaagcccgaaaatcacccgcaacctgactacggcctggtttgcgaagcgcgtagacgaacggcgggcgcgttgtatgaaacagtgatcaaacaggaatgtcaggccagataaggcgtttcaggccgcatctgacaatgtaaaacttactggcggcgatgtcgccagtgcagccatagcgccaccactgcaaaaatgaggcagcctactaaaaacgggatcagcccgaaaatggtgccgacacctaaaccaatttccacccgtgggcgacctgtttcctggacctgcattaaacgctcatagacgccgggcgcatgcactaacaggttcagcaattgcgccccagcccaaaagcaaaacagcacaaacaacgcataggcaatgttgccaggcgttgaagaggcattgcgatattttccgctaaacagcgattttgacagggtgaaatcagccataaaaacctccggaagtcatctgcttctcttctggtgtgataccagcggcttatggcaagtctgacaggtcatttagattgtcaatatcagaatcatggtaaattgatgttgggaatattcccgaagcgtgaatcttcgttgtgagtcacaaaatggcaaccttaagttaaatttattaacaattacgaaaatgttgtctacaccacagacggttgttgcagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattatcgggcgttaaaatattacattgtggttttcaatgcgttatccgcagcgtgacgctccagcgccagttcaatcaaacgtgtgatcagatcggtgtaacccagaccgctggcttgccacagcttcggatacatactgatattagtgaagccaggcagggtgttgatctcgttgatcaccacttcgttctctggggttaaaaacacgtctacacgcgccatgcctgcgcatcccaacgtttgataagcctgaacggcaatcgcccggatcttatcgttgatttctggcgcaatggctgccggaactaccactttcgcgccatcttcgtcaatgtacttggtgtcgtaggcatagaaatcgctggtgagtacgatctctccacaggtgctggcttgcggattgtcgttgcccagaactgcgcattcgatctcacgacctttgatcccttgctcaacgatcactttatgatcgaactcgaacgccagatcgacggcaattgcgtactgttcttcactggttactttgctgacaccaacagaagagccctgattagccggttttacaaacagtggtaaccccagtttagactccacttcggcaaaactaatgttgtgacgattggcgcgcgtcagggtaataaatggcgcaatgttcagcccggcatcgcgtagcagacgtttggtgacatctttgtccatacaggctgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgcgcgtcgataagctgatgctcatgtttacctggcacctgcgcaaggctggtcgccgaagggcgcaacgcaatatgggcaggatcgtctgcatttagcagataattgctggcatcgctgacgtgccattgcccttgtttatcaatgcccagcagcacaacgtcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgaaagattgttgcaatcttctgctgacaaagcgtgcaacgtactggtgaagaaagtgcgttatctcaaagatgtgcgcaagatcacaaaaatgatgaacgggaagctaatttattcctggcttaaatggccatgcggtgagtttttttctcttaattataagttaacgaagagaatatatttcataacttttatttataataaaggttgataattaaaagcctatattttgtgtgggtaattatttaaataagagaaacgtttcgctggtaatcaaacaaaaaatatttgcgcaaagtatttcctttgtcataaaaataatacttccagacactatgaagttgtgaaacataatgttaacttctccatactttggataaggaaatacagacatgaaaaatctcattgctgagttgttatttaagcttgcccaaaaagaagaagagtcgaaagaactgtgtgcgcaggtagaagctttggagattatcgtcactgcaatgcttcgcaatatggcgcaaaatgaccaacagcggttgattgatcaggtagagggggcgctgtacgaggtaaagcccgatgccagcattcctgacgacgatacggagctgctgcgcgattacgtaaagaagttattgaagcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccctgtgacaaaagcccggacaccagaaatgcctgttctggaaaaccgggctgctcagggcgatattactgcacccggcggtgctcgccgtttaacgggtgatcagactgccgctctgcgtgattctcttagcgataaacctgcaaaaaatattattttgctgattggcgatgggatgggggactcggaaattactgccgcacgtaattatgccgaaggtgcgggcggcttttttaaaggtatagatgccttaccgcttaccgggcaatacactcactatgcgctgaataaaaaaaccggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacctcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgagcgatgctgcctcactgaattcggtgacggaagcgaatcagcaaaaacccctgcttggcctgtttgctgacggcaatatgccagtgcgctggctaggaccgaaagcaacgtaccatggcaatatcgataagcccgcagtcacctgtacgccaaatccgcaacgtaatgacagtgtaccaaccctggcgcagatgaccgacaaagccattgaattgttgagtaaaaatgagaaaggctttttcctgcaagttgaaggtgcgtcaatcgataaacaggatcatgctgcgaatccttgtgggcaaattggcgagacggtcgatctcgatgaagccgtacaacgggcgctggaattcgctaaaaaggagggtaacacgctggtcatagtcaccgctgatcacgcccacgccagccagattgttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgctctggggctgaaataaaaccgcgcccggcagtgaattttcgctgccgggtggtttttttgctgttagcaaccagacttaatggcagatcacgggcgcatacgctcatggttaaaacatgaagagggatggtgctatgaaaataacattactggttaccttgcttttcggtctggtttttttaaccaccgtcggcgctgccgagagaactttaaccccacaacaacagcgtatgacctcctgtaatcagcaggcgacggcgcaggcgttgaaaggggatgctcgtaagacctacatgagtgattgcctgaagaacagcaagtctgcgcctggcgaaaaaagtttgacgccacagcagcaaaagatgcgcgaatgcaataatcaagcaacacaacaatctctgaaaggtgatgatcgtaataagtttatgagtgcctgcctcaagaaagccgcctgatacctgatagtgctaacgggtgagctacgaaaatggctcacccgaaatatcatacttctgcctttagctccgtctctataatttgggaaaattgtttctgaatgttcccaaaaataatgaatgatgaaaactttttcaaaaaagcggcggcgcacggggaggaacctcctttaactcctcaaaacgaacatcagcggtccgggctgcgcttcgcccgtcgcgtcagactaccccgtgcggttggcctggctggcatgttcttaccgattgcttcaacgctggtttcacacccgccgccgggctggtggtggctggtgttggtcggctgggcgttcgtctggccgcatttagcctggcagatagcgagcagggccgtcgatccgcttagccgggaaatttacaacttaaaaaccgatgcagtattagcgggaatgtgggtaggcgtaatgggcgtaaacgtgctgccttccaccgcgatgttgatgattatgtgtctgaatttgatgggggcaggcggcccccgtctgtttgtcgcgggtctggtgttgatggtggtttcctgccttgtcaccctcgagctgacgggcattaccgtgtcgttcaatagtgcgccgctggaatggtggctctcccttcccattattgtcatttatcctctgctgtttggctgggtcagctaccagacggcaaccaaactggcggaacataaacgcaggttgcaggtcatgagtacccgcgacggcatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggcgatgaagcgattgtggcgcttacccgacagttacaaattaccctgcgcggtagcgatgtgattggtcggtttggcggcgatgagtttgcagtaatcatgtccggtacgccagctgagagcgccattaccgccatgttacgggtgcatgaagggctaaatacattacgtttgccgaatacgccacaggtaactttacggattagtgtgggggttgcgccgctgaacccacaaatgagtcactatcgtgagtggttgaaatcggcagatttggcgctttacaaagcaaagaaagccggacgtaaccgcaccgaagtggcggcctgacgtccggcgaaagtcatcaggatttgctgagtttttctgatttttccatacacttcgtcatcgcttcgatcactgcagcacggaagcctttctcttccagtacgcgtaccgcttcaatggtggtgcctcccggtgagcagaccatatctttcagtgcccccggatgttctcccgtttccagcaccatttttgcggaacccattaccgcctgagcggcaaatttatacgcctgggcgcgtggcatcccgcccagcacggcggcgtcggccatcgcttcgataaacataaatacgtaggctggcgaagaaccgctcacaccgaccaccgggtggatcatcggctcagcaattacttccgcttcgccaaagcagcggaaaatattcagcacatcagcggtatcttctggggttaccagcgcgtttggcgttacggaggtcatcccggcattaaccagtgcgggagtgttcggcatggcgcggataattttccggtcatggcccagcgcgcgggcaagctggtcgagcgtgacacctgcagcaatagaaacgaccagagagtctttattcaggctggaggtgatttcgctaagcactttaatcatgatgccaggtttaacggcagcaaaaatgatgtcggcgatttgcgccacttcttgcgccgattctgcggcgttgatgccgaactggtcatgcagggcggcgactttatccggggagggggtgtatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgccgataacgaaattgtccggcagtgtgaagcgggcgatttggtgatcaccgcagatatacctttggctgctgaagccatcgagaaaggcgctgcggcgcttaatccgcgcggcgaacgttacacgccagcgaccattcgtgagcgcctgacgatgcgcgattttatggataccttacgtgccagtgggatccagaccggcggaccagatagcctttcacaacgtgaccgccaggcctttgccgcggagctggagaagtggtggctggaagtgcaacgtagtcgtggctaaatgtaatttattatttacacttcattcttgaatatttattggtatagtaaggggtgtattgagattttcactttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttgattttcgagcgcctatacttaacgttcatcccgtgaaataaggaagaacgatgccaacgaaaccgccttatcctcgtgaagcatatatagtgacgattgaaaaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccactacaagggatctgcgtcacatttttcataattcatgtttttctaataattagaatattaaacaataacaatccattactggaatcatttggaatctttacattatgccgtgcacgtctgctgctacgctttttgtcatttgtagcacaagtaagtgtcagcagtggtgcttcacacttgcccggtaattaacgacgaaagaaaagtaaggtggatgaacaatgagtgcgtcgttggcgatcctgaccatcggcattgtacctatgcaggaagttttgccgctcctgacggaatacattgacgaagataatatttcccatcatagcctgctggggaagttaagtcgtgaagaagtgatggcggagtacgcgccagaagcaggcgaagacaccattctcacattattaaatgacaaccagctggcccatgtttcgcgtcgcaaagtggagcgtgacctgcaaggtgtggttgaagtgctcgataatcagggttatgacgtcattttattaatgagtacagcaaacattagtagtatgactgcgcgtaatacgatctttcttgagccgtcgcgaatattgcctccactggtttcctctattgttgaagatcatcaggtgggggttatcgttccggttgaggagatgctgcccgttcaggcgcaaaaatggcaaattttgcagaaatcgccggtattttcattgggtaaccccattcatgattcagaacaaaaaatcattgatgccgggaaagaattactggcaaaaggggctgatgtcatcatgctggattgtttaggatttcaccaacgtcatcgcgatttactgcaaaaacagctcgatgttcctgtcttgctgtctaacgtattgattgcacggctggctgcggaattactggtgtaattttgcgtgacagccagcgcctctggcccctatagtgaagtagatgttcaactaccaaacagggccagtttatgcttcaaagtaatgagtacttttccggcaaagtgaaatcaatcggcttttccagcagcagcactggtcgcgccagcgtgggtgttatggttgaaggcgaatacaccttcagcaccgctgagccggaagagatgacggtaatcagtggcgcgctgaatgtgttactgcctgacgcgaccgactggcaggtgtatgaagccggttcggtgtttaatgttcccggtcacagtgagtttcatctgcaagttgccgaacccacctcttatctgtgccgctatctgtaattcctcgccttccccttgaacgggagggcatttttctgaaatatcctttctttagcccataataatatttcctttgctgcgattttttcaatttccgatatattcataatttatcaaggttgatataaatatcagtgaagatctccagatattgttgcggaactggctacgataaaagataaatcagatgatgaatggtggcgtgcattgctgcaaagtcgcaatgatcatttacgccaaacggcattgcgcaacgcacataccccggcgttgttgttaacgacattgactgagcctcaggatcggtcgctggctattaataatccacagctggctgccgatgtgaaaacggcgtggttaaaagaggatccatcattactcttatttgtcgaacaacccgatctttcgctgttacgtgatttagtgaaaaccggggcaacgcggaaaattcgcagtgaagcgcgtcaccggcttgaggaaaaacaatgacacaacgtccatggagcaagttacagcgtaaaacgcataatattgctgcgctaaaaattattgctcgccgtagcgaataattatatgcctggtgtggcttcgtacgccggataagacgcggcaggcgtcgcatccggcattaaaggaaaatcagcaattaacgttgtgcttcgccacctaatccttcaatcaggttttgaattaacgctgccagttcaccagtcatcaggatgaaatcggcatcaaaacgctgggcgaaatcttcacggtcgatatcttcgttttgatcgcgcagctcgtcgcagaacttcagacgcttgagcgaaccatcgtcgcacatcacaaactgaatgcgctgctgccagtcgagcgccagtttagtcaccacttttccggcttcaatgtgattggtgatctcttcgctggtcagatcttgtttcttcgcgcggatcacgccgccatcttccagcaacgatttcagctcggcttcatcaagcagctggaagccctgtgccgcactaccggagcgaacccattcggtcagcgtcagttcaatcgggttttccatgctcaatggtacaaccggtaacgaccccaggcttttacgcagtaatgccagcgtatcttccgcttttttggcactggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttccgcttccagtttggcgattttcgcttccagcgcctgtttaatcaccggagacgggaggattttttcttctttgcgcgcgcagataacaatttgaccattggcaacgtgcgttaacgcatcgctgtgcgatcccatcggaggaacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaaataaggagagtaccgtgcgtataggtatcgatttaggcggcaccaaaactgaagtgattgcactgggcgatgcaggggagcagttgtaccgccatcgtctgcccacgccgcgtgatgattaccggcagactattgaaacgatcgccacgttggttgatatggcggagcaggcgacggggcagcgcggaacggtaggtatgggcattcctggctcaatttcgccttacaccggtgtggtgaagaatgccaattcaacctggctcaacggtcagccattcgataaagacttaagcgcgaggttgcagcgggaagtgcggctggcaaatgacgctaactgtctggcggtttcagaagcagtagatggcgcggcagcgggagcgcagacggtatttgccgtgattatcggcacgggatgcggcgcgggcgtggcattcaatgggcgggcgcatatcggcggcaatggcacggcaggtgagtggggacacaatccgctaccgtggatggacgaagacgaactgcgttatcgcgaggaagtcccttgttattgcggtaaacaaggttgtattgaaacctttatttcgggcacgggattcgcgatggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctggggggcgggatgagcaatgtagaccgtttatatcaaacggttgggcagttgattaaacaatttgtcttcggcggcgaatgtgaaacgccggtgcgtaaggcgaagcacggtgattccagcggcgtacgcggcgctgcgtggttatggccacaagagtaaaaaacgtaggcaattggcgcatcatgcctgatgcgacgcttgccgcgtcttatcaggcctacaaaaggtgccagaaccgtaggccggataaggcgttcacgccgcatccggcaataagtgctccgatgcctgatgcgacgcttgccgcgtcttatcaggcctgcaaaatgtgccagaaccgcgtagggcggataaggcgttcacgccgcatccggcaataagtaatgagcaccgagactataacctaccccagtggtttcgccagcaccggagtatccgccgcttgctggcgcttatagcgaccatacagcagcaacgacgacatcgcagcaaacgaaagcagggcggcaggcagcgccacgtaattatatgccagccccagcgtcagcatcatacctccgcaatatgcgccgacggcgctaccgaggttaaacgctatttgcccacctgcggcacctaataactctccgcctttggcgttttgtagtaacaatatttgtagcggtgctgaaagggcaaataatcccgcgcaacaaataaaagcaaaaataagcgacgttgttttcatgccgccgcagaaaaagagcatcagcagtgccagtacaattataaagtcagtcactgctgcaatgcgcagtggtgaataacgtcctgaaatcctgccacttagcatatttcccagcaccatccctagcccaactaacatcataataaaggtcatcgccgtttccgaaaaaccggaaataaacatcatgtatggctttacgtagctgaaccaggcaaacacacctgcgttgccaaacatcgtggcggcgaaaattaaccacggggccgggctgcgcaaaaagtgaaattgttcgcgcagatttcctttcgcctcgtcgcgaatatctggcacccaaaaatagaccgatgccatcaccgcaatattaaaaacagcgatcaataaaaaggtgtaacgccagctaaattcctgacttaaatacgttcccagcggaatgcccagcaaattggcgactgtcatcccggaaaccatccccgccacggcggcggtgacttttccgggtttgataatttttgataacacgatcgctccgacgccaaaaaatgcgccatgcggaaagccggataccagccgaccaatggcgagcatcaggtaagacgaagagagcgtgaacatggcgttgccaatgacgcacaacgccaccagaaacaacaagatatgtttgagtgagtagcggctggaaaagagtgcgatgattggcgcaccgaccaccacccccagtgcataatacgagatcatatgcccggcggcaggaatcgaaattcctacgttatgcgccagctccgtgagcacgcccataatgccaaattcggccatccccaaaccaaacgtgcccagagccaaagataaaatgacttttttcataccaccatcacaaccaccagaacggctaccaatcaccgtagccaataaagtgatagcttgcaggataacgaccagcaaggccaagagataattcgcccctctgtattcattatcctgctgaatagttatttcactgcaaacgtactttccagtttgctgtagcccaggccgttgatctttttcactttgatctgcaccggaatacgctctttcatcgcttctacgtggctaatcacaccgatggttttgccactggcgttcagggcatccagcgcatcaagggcggtatccagcgtttcgctatccagcgtgccaaaaccttcatcaaggaacagcgagtcaatacgtgttttatggctgaccagatccgaaagcgccagcgccagcgccagactaacgaggaaactttcgccgccggaaagggtacgggtatcgcgtaccgcatctgcctgccaggtatcaacaacctcgacttccagcgcctcgctggctttgcgctgtaacagatagcgcccgtgcagccgggtaagttgctgattagcgagatggactaaattatccagcgtcagcccctgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagccaacccgtcgtcaggtcggtgttgttgatgctgtgccagcgtttctgctgtctgagtgaccagagtttgcgcctgacggcgctggttttccagattctgcttgagctgttccagctgcgttagtgtttgttcatccattagcgccgcaaggaacgcctgctgatcgtcaaagacgctggcctgtagcgcggtgtcaaactgcgcctgggctttttgcagactttgcgccgccagaacatcctgttgctgtaacgtctgctgctggctgtgtaatgcgagacattgttcatgtacctgccgccagttttccaataccacagtttcttcgcagtgcgggagttcatcactttgcggcaacgtttccagaatcggcgtcagctgctgaatacggttttgcagcgcggttaattcgttctggcgttgctgccagctctgcgcttcttgctgacgtgtcgccaaccagctctcttcttcatcttcctgtggcaatgtcagtgcataacccgtcaatgtcgttaaaagtagttgctggcgttgttcaatttgctgttgatactggataatttgctgattatgcgcggcaatctgcccttgtaattcatgccgttggctgagtaaccgcagctggcgttcgtgctcatcttgtgcatccagccacggttgaatatcgtccagtggctgcaaggtgatattgaggctggccgtgacggcttgccattgttgagtaagtgcttgctcatcttgtcggaggctttgcgcttcgttttcatcacgctgaagctgctttgttatggcgtccagttgcccacgtagcgtcgcaccttcttcaccgagctttttaacttcgttttccagcgccagtaatcgagactgattaacgccaggctccagcgcctgatacgcctcgaccgccgggtggctggtggaaccacaaagtgggcaaggctgacccgcctgtaactgtgcacgttgagcttccagcgttttgatgcgcgcttcctgctcgcaaatggttttcacatcggcaagttgctgcgtcttttctttataacgctggcgcatttcgttaagtgcggcgttacgttgcgtctgttcttgcgtgacattctggatagcgacctgtaactgcgccagacgtttttgttggggaacaatctgtccatgcagcgcgaccaggtgctgacgcagtgggcgttgctcagcatgttgcgccagggcggtagcaacttcatcggcggttaacgtcaacgtgatcgccgcaagcgcattaagtttttgctcagcatgggttaactgttgctgccattgccgcagatgctcgcgatcgctggtttgttgggagaactgcgcacgccaacccgccggttcgttgttccactgacggaagcggtcgtgttcctgtaaccaggtattcaggctttgttgctgctgctgtaattctgctgactgcttcgccgcgtggtggcgaatgctcgcgcgaagcgccattgtgctctgtaagcgagtatttacttcttcaatctgctggcgaatatgcgccagcgccgcgctgtgttctgcgatgcgttcccagtgtggacgaagatttcgtgccggttgtgccagactaagcgccgccagttgaggttgcgctttttcttcttcggctaacgcctgttgcaaggcctgctgacggcggctggcttcttgctgcaattcgtcctgacgcgttaaccagtttagcgattgttgttcttgctgctgcgcggtaattaactgtttttcttcgtcagtaagtacctgcaaactcgctgtcagcgattgcacttgttccggcgtgagcaacgtgacgccgctggcctgcgcttgcagcttctccagctctgtgcgggccgatttgtgctgctcaaaaaccatcgccgagatttgcccgtagatttcagtgccggttaactcctcgagcaattccgcgcgttctttgggtttggcattcaggaaggcagcaaattgcccctgcgaaagcagcatcgaacgggtgaagcgcccgtaatccagcccggttaacgtcgctgtcagttccagcttatctttcactttgtcggcgagaattttgccgtcggcgcagcgcgccagctctacgcgtggcacctgcaaattaccgtcgggttggttacgcgcccgattctggctccagaatgcacggtacgcttcacctttcacttcaaactccacctccgccagacattcggcggtatcgcgggtcatgagatcattttgcgattgtgaaacgttagagagacgcggagtttcgtgatacagcgccagacaaatggcgtccagcagggtggttttccccgcacctgttgggccggtaatagcaaacagcccgttgctggcgaacggctcgcgggtgaaatcaatcttccattcgccttttaatgagttcaggtttttcaggcgcaggctgagaattttcatgcttcgtgttctccggcgagggtatgcaacgtcgtggtgaaaagatgctgcagacgttgctgctgcgattcatccagttcttccagtgccagacggcgattgaacacctcttcgacgctgagttcgctgagggtttcacgctgttggctggctaacacacgctcgcgctgttcacgactccgacgtaccagcaatacttcgacaggcaatgattcggttaatgcctggattttgcgctgaatatcatgcagatactcatcagtagtgatttcgatatccagccagacaggtggctcctgcgatacatcgcgccactgttccagctgtgcggtaatcgacgccagatcgcctttcagcactgccatgggttgcgttaccggtacgttcaggttttccacgctctctaatttgccgtttgaaaatgtcaccagatggacatatttactcttaccgcattcatcaaaactcagtggaatgggggagccgcaatagcgaacatgttccatgccgccaataatctgtgcgcggtgaatatgcccgagcgcgatgtagtcggctggtggaaagttttgtgccggaaacgcgtccagcgtgccaatataaatgtcacgcacggcgtcacttttactggcccccacggtcgttaaatgtcccgtggcgatgatgggcagaggctgatcgccgcgcagtttgcaggcatcggcatagtgttgttggtaataatcggtaatcgctgccagtaaatgctgctgtttttcaataccgttaagccccgcctggctggtaataatgtcacgcggacgtaaaaacggaatggggcacagcactgcgcctggcgtcccgtcgcgacgaggcaagatttgcggcgcatgtccggcgctggcgaccacggtagtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccggcaacaataatcgcatccacctgatgggtttgtgctgtctccagcagccagtcaagaaaagcctgatgttcagcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctcctcgactggatgttacctggcggctccggtatccagttcatcaaacacctcaagcgcgagtcgatgacccgggatattccagtggtgatgttgaccgccagaggggaagaagaagatcgcgtgcgcggccttgaaaccggcgcggatgactatatcaccaagccgttttcgccgaaggagctggtggcgcgaatcaaagcggtaatgcgccgtatttcgccaatggcggtggaagaggtgattgagatgcagggattaagtctcgacccgacatctcaccgagtgatggcgggcgaagagccgctggagatggggccgacagaatttaaactgctgcacttttttatgacgcatcctgagcgcgtgtacagccgcgagcagctgttaaaccacgtctggggaactaacgtgtatgtggaagaccgcacggtcgatgtccacattcgtcgcctgcgtaaagcactggagcccggcgggcatgaccgcatggtgcagaccgtgcgcggtacaggatatcgtttttcaacccgcttttaacgccttgctcatcggacgcagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgcagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgtaacggtctggcgcaacaaattcttggtttgcgctggccggaagataacgggcagaacatccttaacctactgcgttacccggagtttacgcaatatctgaaaacgcgtgatttttctcgcccgctcaatctggtgctcaacaccgggcggcatctggaaattcgcgtcatgccttatacccacaaacagttgctgatggtggcgcgtgatgtcacgcaaatgcatcaactggaaggggcgcggcgtaacttttttgccaacgtgagccatgagttacgtacgccattgaccgtgttacagggttacctggagatgatgaatgagcagccgctggaaggcgcggtacgcgaaaaagcgttgcacaccatgcgcgagcagacccagcggatggaaggactggtgaagcaattgctgacgctgtcgaaaatagaagccgcaccgacgcatttgctcaatgaaaaggttgatgtgccgatgatgctgcgcgttgttgagcgcgaggctcagactctgagtcagaaaaaacagacatttacctttgagatagataacggcctcaaggtgtctggcaacgaagatcagctacgcagtgcgatttcgaacctggtctataacgccgtgaatcatacgccggaaggcacgcatatcaccgtacgctggcagcgagtgccgcacggtgccgaatttagcgttgaagataacggaccgggcattgcaccggagcatattccgcgcctgaccgagcgtttttatcgcgttgataaagcgcgttcccggcaaaccggcggtagcggattagggttagcgatcgtgaaacatgctgtgaatcatcacgaaagtcgcctgaatattgagagtacagtaggaaaaggaacacgtttcagttttgttatcccggaacgtttaattgccaaaaacagcgattaatccgcctttgtcatcttttattgccataagccagtcgatgctggcttattttctttgcagtcaaaatacgggcgttagattttacaacgattggtgattttttgttcgcatgattagccatgtctttttcacggaaatagtgttttatactggttggtgatttcttatcgctatatacctctggtttttagatccctccttgctttaaaacgttataagcgtttaaattgcgcttcaggtgctgtcatactgactgcattaacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttacaggcaggcgaacacgtctggactgcggcattcggcttcctcattactgccgttggcctgccggtattaacggtagtggcgctggcaaaagttggcggcggtgttgacagcctcagcacgccaatcggtaaagtcgctggcgtactgctggcaacggtttgttacctggcggtggggccgcttttcgctacgccgcgtacagctaccgtttcctttgaagtggggattgcgccgctgacgggtgattccgcgctgccgctgtttatctacagcctggtctatttcgctatcgttattctggtttcgctctatccgggcaagctgctggataccgtgggcaacttccttgcgccgctgaaaattatcgcgctggtcatcctgtctgttgccgctattgtctggccggcgggttctatcagcacggcgactgaggcttatcaaaacgctgcgttttctaacggcttcgttaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctggggtcagacagcgcgtcgctggtcgatcagtctgcaaacggcgctgctattctgcatgcttacgttcagcacacctttggcggcggcggtagcttcctgctggcggcgttaatcttcatcgcctgcctggtaacggcagttggcctgacctgtgcttgtgcagaattctttgcccagtacgtaccgctctcttatcgtacgctggtgtttatcctcggcggcttctcgatggtggtttctaacctcggcttaagccagctgatccagatctccgtaccggtgctgaccgctatttatccgccgtgtatcgcactggttgtattaagttttacacgctcatggtggcataattcgtcccgcgtgattgctccgccgatgtttatcagcctgctttttggtattctcgacgggatcaaagcatctgcattcagcgatatcttaccgtcctgggcgcagcgtttaccgctggccgaacaaggtctggcgtggttaatgccaacagtggtgatggtggttctggccattatctgggatcgcgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaacgttttataacgccttgcgtgacgcctgcgccatcatccgcggataaaactgccagaagcgggtttcgagggcgtcataatgagcgtctaaatcgtaccaggagtcacgcagggcatccagacgtgggcggcggcttgccatgccgtttaacacgttctggatgaaatccatatcgcgatagcgcaccagccactgctctgaccacaagtaattgttcagattgataaaacgtggcggtgagtccggcaaaatcgtcatcacttgctcgcgggcataacagacaaattcctgtagcggaaagtccggcgacagctgcgaccagtggcgggaaagaaagtgatcccacatgacatccagcgtaataggcgcaacgcggcgcgtttcactacgaaaccactcccgtgcttcgcggacttccggcagattgtcagtcaatacgtcgatacgtcgatgcatatgaatgccagccacgacgtcgggcggaaaactttcttcaggatttccgcgtacgaaatcagccagtaaattgccggaaagcgagctttccgcgagatgggctaaatgcaggtgagctaaaaaattcatcgattatattctatccaaaagggggtaaaggttgcagggagagcgccccggcactagactacccgcctcttattttagtctgagtcagtgtcatgcgcgttaccgatttctcctttgaattgcccgaatccctgattgcccactatcccatgcctgaacgcagtagctgtcgtttactgtcgctggacgggccgacgggcgcgctgacgcacggtactttcaccgatttacttgataagctcaaccccggcgatcttctggtttttaataatacccgcgtgatcccggcgcgcctgtttgggcgtaaagccagcggcggcaagattgaagtgctggttgaacggatgctcgacgacaaacgcattcttgcgcatattcgcgcctcgaaagcgccaaaacctggcgcagaactgctgctgggcgatgacgaaagtattaacgcaacaatgaccgcgcgccacggcgcactgtttgaagtcgaatttaatgatgaacgctcggtgctggatattctcaacagcatcggccatatgccgctgccgccgtatatcgaccgtccggacgaagacgctgaccgcgaactttatcaaaccgtttatagcgaaaaaccgggcgcggttgcagccccgaccgcaggtctgcattttgacgagcctttgctggaaaaattgcgcgccaaaggcgtggagatggcgtttgtgacgttgcacgttggtgcgggcaccttccagccggtgcgcgtcgacaccattgaagatcacatcatgcactcggaatacgctgaagtaccgcaggatgtggtagacgcggtactggcggcgaaagcgcgcggtaaccgggtgattgcggttggcaccacttcagtacgttcgctggaaagcgcggctcaggcagcgaaaaacgatctcattgaaccgttcttcgacgatacccaaatctttatctatccgggcttccagtacaaagtggtcgatgcgctggtgacgaacttccacttgccagagtcgacgctgattatgctggtttcggcctttgccggttatcaacacaccatgaacgcctataaagcagcggtagaagagaaatatcgcttttttagttacggtgatgcgatgtttatcacgtacaatccgcaggcaattaatgagcgcgtcggggagtaattccgcggcgctggtttaaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacctacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaggggccgatcctcaccgactccggcggcttccaggtcttcagccttggcgatattcgtaaaatcaccgaacagggcgtgcacttccgtaacccgatcaacggcgatccgattttcctcgatcctgaaaaatcaatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcatccagggcagcgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgaaggcgtacgtcgtggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatcttgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccattgccaaaggtgatgaagttctgacgaacggtggcctggttggtcgcgtaaccaaagtagcggaaaacggctacattgctatcgcgctgaatgacaccactgaagtagttattaaacgtgacttcgtagctgccgtcctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagttgcgcgctcgtgaagcattaatgggcgttatgggtgacaaatacgtcgtggcgcttaaccttgccccggcaacgccgcgctggctggcagctattcacgctgagccgatgaagctcggccttgacctgcgtggcggcgttcacttcctgatggaagtggatatggacaccgcgcttggcaaactccaggaacaaaatatcgatagcctacgcagtgacctgcgcgaaaagggcatcccgtataccactgttcgtaaagaaaacaactacggcctgagcatcactttccgcgatgctaaagctcgtgatgaagccattgcgtatctgagcaagcgccatccggacctggtgattagcagccagggcagcaaccagctgcgtgcggtaatgagcgatgctcgtctgagtgaagcgcgtgaatatgcggtgcagcagaacattaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgaccaggccgctgcggcatccggtcgcgtaccgggcgactctgaagtgaaacagacccgcgaaggtcagccagttgtgctgtacaaacgcgtaattctgaccggtgaccatatcaccgactccacttccagccaggacgaatacaaccaaccgcaggttaacatctcgctcgatagcgctggtggtaacatcatgtctaacttcactaaggacaacatcggcaaaccgatggcaaccctgtttgtggagtacaaagacagcggtaagaaagatgcaaatggtcgtgcggttctggtgaaacaggaagaggtgattaacatcgccaacatccagtctcgtctgggtaacagcttccgtatcaccggcatcaacaacccgaacgaagcccgtcagctgtcactgctgctgcgtgccggtgcgttgatcgcgccgattcagattgttgaagaacgtaccattggcccaaccctgggtatgcagaacattgaacaggggctggaggcttgccttgccggtctgctggtttctattctgttcatgatcatcttctataagaagtttggtctgattgcgaccagtgctctgattgccaacttgatcttaatcgtcggcattatgtcgctgttgccaggcgcaacgctgagtatgccaggtatcgcgggtatcgtcttaacccttgcggtggcggtcgatgcgaacgtactgatcaacgaacgtattaaagaagagttgagcaacggacgtactgttcaacaggcaattgatgaaggttatcgtggcgcattcagttctatcttcgatgcgaacatcaccacgctgattaaagtcatcatcctgtacgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgctgctatcgttattatgggcgtgcgcggctttaactgggggctggatttcaccggtggtacggttattgaaattacgctcgaaaaaccggctgaaattgacgtaatgcgtgatgcattgcaaaaagccggttttgaagagccgatgctgcaaaactttggtagcagccatgacatcatggtccgtatgccgcctgctgaaggcgaaaccggcggtcaggtgttgggcagccaggttctgaaggtgattaacgaatccaccaatcagaatgcagcagtgaagcgtattgagttcgtcggtccgagcgtgggggcagaccttgcgcaaaccggtgcgatggcgttgatggcagcgctgctgtctatcctcgtgtacgtaggtttccgctttgagtggcgactggcggcaggggtggttattgcgctggcgcacgacgttatcattacgctgggtattttgtcgttattccatatcgagattgacctgaccattgtggcatcgttgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgttggctctgaaactgggtatgaagcgcgaacacatgttgcagcagaaagtggaaaaagaaggggcggatcagccgtcaattctgccgtaatcaagttcccgttgatgttgaaaatcccggtcagaagatcgggattttttttgatgtatggagattgcgaaaatccccgcatcttgggaaactgcgcgtaaccctacatttcatccaggtaacttttcatggctatcatcccaaaaaactatgcgcggttagaaagcggctatcgcgaaaaagcattaaaaatctatccgtgggtctgcggtcgctgttcccgcgagtttgtttattccaacctgcgtgaacttaccgttcaccacattgatcacgaccataccaataacccggaagatggcagtaactgggaattgttgtgtctctattgccacgatcatgagcattcgaaatataccgaagcggatcagtatggtacgaccgttatcgcaggggaagatgcgcagaaagatgtcggtgaagcgaagtacaacccattcgctgacctgaaagcgatgatgaacaagaagaagtgattaaaacgtaaaattgcctgatgcgctacgcttatcaggcctacgttatttcagcaatatattgaatttacgtgcttttgttggccggacaaagcgtttacgccgcatccggcatgaacaaagcacacgttgttaacaatcagaaatgccgggaataaatcccggcattttcataatcagaagttgtaacctactaccaggtaaccaccccagccggtagagcgaacgttgaagttgccgttgccgaagttcagttctgcatcgtcgttccactgaccaccgtcgtgccagtaacgagctacgacagagtagtgccagtgatcgtagttcagagccagaatatggctggaagcgatagagttattagtacgggtcttaataccgttgattgcgttaccgctgtcatcccctaaatcggaaccccagtcgaagttggtgaagccgatgtagctcagctgaccgccccacagatcggtaatcggcacaaagtatttaattttgaaacggtaaccgtcccactcgttttcgttcgctgcgccatagttctgccactggtatttcgcatagacgttcatggacaggctcatcggcaggccagtgtcgatatcggtacccagacccatgtaccaggtgctctggcgaccatctttattacgacccatgtcgtaaatgtagttgttcgcgaagtaccactctttgaacggaccgaagctaaggtcagtattggtcagcttgtcgatggagaaacgtggttcgatttccataaacagcggagaaccgtggttccagatacctttagcatcggagttaccgccgaagaataccggcgcatccgcataaccatagaagtcgaaccagtcttttttagcgaatgcttcgtactcaaggtaggtatcgttgcggatctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcgcccttgttgcaaacttttactatcaatccaggtgatgtaagcagagtaacaaaatgacggggaaagatgttgcgggacgcacaaaatcgtcccgaaatacgtttactgcataacaggttgaatgtcgtggatacgtacaaagcctaactgatccacagaaatcccctttaactgtaacggaatatcaacatcgctgggggcgaggacgctggcaggggcattaatcaattgattctgcacattgatttcctgaaagttgtctattgttccctgaatttgcccatattcaacagttccgctgaatgcgggcaagggatcattcgactcaccctgaatacgtagtgtaagggtggtgccatctgcatcaggcgtaatattcaccagcgacatacgtaaagtaccgatctggctttccagtcttgccggtgttttcgctccaggcagaaggtaaaccccactgctggattttgcattcagcctgttttgctgagtgattttgactgtttcttgattgagttgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagcgaaagcatcgatcctttatctcaaaagcgttgcgcctttgttgtatcgtcagttcagggtaaaatagatttccgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattgcgtagcggaatgctgcgggcgctggaaaaacgtccggtgagttccgatgacgtcgaaatggcaatcaatcatattaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacggcctgatgatgagtgaagccgagcaattgaataaaggctttctcaagcggatgcgcaccggctttccttatattcagttaaaacttggcgcatcgcttgatggtcgcacggcgatggcgagcggcgaaagccagtggatcacttcgccccaggcgcggcgtgatgtacaactactgcgcgcgcaaagtcatgccattttaaccagcagcgccacggtgctggcggatgatcctgccttaacggtgcgttggtctgaactggatgaacaaactcaggcgctctatccgcaacaaaatctccgtcagccgatacgtattgtgattgatagccaaaatcgcgtgacgccggtacatcgcattgtgcagcagcccggcgaaacctggttcgcgcgtacgcaggaagattctcgtgagtggccggaaacggtgcgtaccttgctgattccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccgttgtttgggtgcctggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggggttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaataccgcatacctcgacggactgatgaagccatacctgtcccgcctgctggaagaactgggacaggtagaaaaagcagtactgcgcattgcgctgtacgaactgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtgatatccaggccggtagattcacggaagaccgttccatgatcgccggccttttcttttttacctgctgaggcataacgtatggcatgtggcgagttctccctgattgcccgttattttgaccgtgtaagaagttctcgtcttgatgtcgaactgggcatcggcgacgattgcgcacttctcaatatccccgagaaacagaccctggcgatcagcactgatacgctggtggcgggtaaccatttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagtttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgccgccgggctggcgattttgcaaaaccgtttgcaggttgccgatgctaaagatgcggactacttgatcaaacgtcatctccgtccatcgccgcgtattttacaggggcaggcactgcgcgatctggcaaattcagccatcgatctctctgacggtttgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcactgtgccggaactgaaccgtggcgcgctggatgtggctctcggacacctgggcgtaccgtttacctgtatcgggcaaatgaccgccgatatcgaagggctttgttttattcgtgacggcgaacctgttacattagactggaaaggatatgaccattttgccacgccataaagatgtcgcgaaaagtcgcctgaagatgagtaatccgtggcatctacttgctgtcggattcggaagtggattaagcccgatcgttcctgggacgatgggctcgctggcagcgattccgttctggtatctgatgacctttttgccctggcagctctactcgctggtggtgatgctggggatctgtatcggcgtctatctttgtcatcaaacggcgaaagacatgggtgtgcacgatcatggcagcattgtctgggacgaatttattggtatgtggatcacgctcatggcgctgccgaccaatgactggcagtgggttgccgccgggtttgtgattttccgtattctggatatgtggaagccgtggccgatccgctggtttgatcgcaatgtgcatggcggcatggggatcatgatcgacgatattgtcgccggggtgatttccgcaggcatcctgtattttatcggtcatcactggccgctgggtattctgtcgtagttgtgcaccgatgcctgatgtgacgcttgtcacgtctcatcaggcctggactcttatttaaatcctacgacaggatgcggtttatacggcgtttccagttcggcaatctgttccggcttcaaagtgatatccaccgcgttcaatagctcatcaagctgttcttcgcgcgaagttccgataatcggtgcggcaatgcccggtttactcaacaaccaggccagcgcaacttgtgctcgtgtcgcccccagttcttcactgacgcctgttaaccgctctgcgatctgcgcgtcattttcatcgctttctttatagagatttttccccacctcatcagacaccagtcgtgcggtagtttctccccacggacgcgtcagacggccccttgccagcgggctccatggaattaccgccacgccctcctgataacacagtggtagcatctcgcgctcttcttcacgataaatcagattgtagtgatcctgcatactgacaaactgcgcccagccgtgctgtttttggagttccagtgcctgagcaaactgcgaagcgtgcattgatgacgcgccgatataacgcgctttcccggcttttaccacgtcgttgagggcttccagcgtctcttcgatcggcgtgttgtaatcccagcgatgaatttgcaggatatcgacataatccatgccgagacgtcgcaggctgtcgtcgatagagcgcaaaatttgcgcacgggataatccttccggtaaatcaccaacgcgatggaacactttggtcgcaacgaccacgtcttcacgacgggcgaaatcccgcagtgcgcgaccgacgatctcttcgctgctgccgtcagaataactgttggcggtatcaaagaaatttatgccgccttccagtgcacgtttaattatgggacggctgctttcttccggcagtgtccatgcgtgattaccgcgatctggctcgccaaaggtcatacagccgaggcaaagtcgggaaacgcgaaggtcggtttttcctaaggggttgtattgcatgctgccactcctgctatactcgtcatacttcaagttgcatgtgctgcggctgcattcgttcaccccagtcacttacttatgtaagctcctggggcttcactcgtttgccgccttcctgcaactcgaattatttagagtctatgaataatttcttaagcatagcaggagtggagtagggattatgccagccaggccttgattttggcttccataccagcggcatcgaggccgagttcggcgcgcatttcttcctgagttccttgcggaataaagaagtccggcaggccaatgttcagcacgggtactggtttacgatgggccatcagcacttcgttcacgccgctgcctgcgccgcccataatggcgttttcttctacggtgaccagcgcttcatggctggcggccatttccagaattaacgcttcatcaagcggtttcacaaaacgcatatcgaccagcgtggcgttcagcgattcggcgactttcgccgcttctggcatcagcgtaccaaagttaaggatcgccagtttctcgccacgacgcttcacaatgcctttgccaattggtagtttttccagcggcgtcagttccacgccgaccgcgttgccacgcgggtagcgcaccgctgacgggccatcgttatagtgatagccggtatagagcatctggcgacattcgttttcatcgctcggggtcataatgaccatttccggtatgcagcgcaggtaagagagatcaaaagcaccctgatgggtttgaccgtcagcaccaacaatgcccgcgcggtcgatggcgaacaggaccggaagcttttgaatcgccacgtcatgcagcacctgatcataggcgcgttgcaggaaagtggagtaaatcgcgacaatgggtttgtacccaccaatcgccagacccgcagcaaaggtcaccgcgtgttgctcggcaattgccacgtcgaagtagcgatccgggaatttacgtgaaaactcgaccatgccggaaccttcacgcatcgccggagtaatcgccatcagcttgttgtctttcgctgccgtttcgcacaaccagtcgccaaagatttttgaatagctcggcaaaccgccgctacttttcggcaaacaaccgctggagggatcaaatttaggcacggcgtggaaagtgatcgggtctttttctgccggttcataaccacgaccttttttggtcatgatatgcaggaactgcgggcctttcaggtcgcgcatgttctttagcgtggtgataagccccagcacatcgtgaccgtccaccgggccgatgtagttaaagcccagctcttcaaacaacgtgccaggcactaccatgcctttaatatgttcttcggtgcgtttgagcagctctttaattggcggcacgccagagaaaacttttttcccgccttcgcgcagtgaagagtaaagcttaccggaaagcagctgtgccagatggttgttgagcgcgccgacattttcggaaatcgacatttcattgtcgttgagaatcaccagcatatcaggacggatatcgcccgcgtgattcatcgcttcaaacgccatgcctgcggtaatcgcgccatcgccaatgacacagacggtgcggcgatttttgccttctttttcggcagcaaccgcaataccaattccggcactgatggaggttgatgaatgcccgacgcttaatacgtcatattcgctttcgccgcgccacgggaacgggtgcagaccgcctttctgacggatggtgccgattttgtcgcggcgtccggtcaaaattttatgcggataagcctgatgccccacatcccaaatcaattggtcaaacggggtgttgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctggtcggcaccctggcgttttcccaacgttgcagtatctcccaccacatccaggatgtcatcctgaacctggaaggcaaggccgatgctctctgcatacttgtcgagtaccggcagagcacgacgtcctttatctccggcgcttaatgcaccaaggcgaacggcggcgcgaatcaatgcgccggttttatgacgatgaatacgctcaagcgcgtccagaggtacgtgtttgccttccgcgtctaaatctaatgcctgaccaccgcacattccggcaataccactggcgctcgccagttcagaaatcatcgaaattctgtcgcggtccgacacttccggcatatcggcatcgcttaaaatcgagaacgccagcgtttgtaaagcgtcgccagcgagaatcgcgtttgcttcgccaaacttcacatggcaggttggcaaaccgcgacgcagatcgtcatcatccattgccggtaaatcatcatgaattaatgagtaagcgtggatacactcaacggcggcagcgggtgcgtccagcgtgtttgtgctaacgccgaacatatgaccggtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggcgcctcatttttcttcggcataatgaatgtctgactctcaatatttttcgccccgtcatggtaacggactcagggcaaatagcaaataacgcgcaatggtaaggtgatgtgcacagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgccactgggataacatcgaagttcgcgcaaaagatgaaaaccagcgtctggctattcgcgacgctctgacccgtattccgggtatccaccatattctcgaagtcgaagacgtgccgtttaccgacatgcacgatattttcgagaaagcgttggttcagtatcgcgatcagctggaaggcaaaaccttctgcgtacgcgtgaagcgccgtggcaaacatgattttagctcgattgatgtggaacgttacgtcggcggcggtttaaatcagcatattgaatccgcgcgcgtgaagctgaccaatccggatgtgactgtccatctggaagtggaagacgatcgtctcctgctgattaaaggccgctacgaaggtattggcggtttcccgatcggcacccaggaagatgtgctgtcgctcatttccggtggtttcgactccggtgtttccagttatatgttgatgcgtcgcggctgccgcgtgcattactgcttctttaacctcggcggcgcggcgcatgaaattggcgtgcgtcaggtggcgcattatctgtggaaccgctttggcagctcccaccgcgtgcgttttgtcgctattaatttcgaaccggtcgtcggggaaattctcgagaaaatcgacgacggtcagatgggcgttatcctcaaacgtatgatggtgcgtgccgcatctaaagtggctgaacgttacggcgtacaggcgctggtcaccggcgaagcgctcggccaggtgtccagccagacgctgaccaacctgcgcctgattgataacgtctccgacacgctgatcctgcgtccgctgatctcttacgacaaagagcacatcatcaacctggcccgccagattggcaccgaagactttgctcgcacgatgccggaatattgtggtgtgatctccaaaagcccgacggtgaaagcagttaaatcgaagattgaagcggaagaagagaagttcgacttcagcattctcgataaagtggttgaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagaacaaaacctggctgctgtggtgtgagcgcggggtgatgagccgtctgcaggcgctctatctgcgcgagcagggctttaacaatgtgaaggtatatcgcccgtaatttgtggtttttacgtcgcatctggtcagatgcgacgtttgccgcatccgacactactcgtaataattataaatccctgccgccatcaccagttgtgatgccacttcatgggctttttcacgcccaaccaacaggtcgataattttcagaccaaagtcgatagctgtacccggcccctggctggtcagcaattttacccgtgcatcccagacgacgcgcttgtccagccattgttcggcgggaattttgtctttcagcgtcgggaagccggtcatattaccaatcgggaagatatcgtgcggcaccagcacggtggctggcgcggcgcaaatagccgcgacgatacgcccggaacggtggaactgtttaacggtttcaaccagcagagtgctatcgcgaaaacactccgcgcctttaatgccaccaggcagcacgatcacgtcatattcgccatcagccacttcgaccagcggcgcatccgccagcagcttcacgccgcgcgagcaggtaatcgccaggttaccatcgctggcgacgctggcagtggtgactttgataccgccgcgaaccagcagatcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcagtgtggcgcagcgcgcggatatcctgcaacatcgacgagatattttccgctgtggcatcaatcacctgcatcacgtaatcacgcaaatcttctgctgaagtatgatgcccttcgcgttcgatcaccgccgcgacttcttcgcatatctgcataatttcttgcggatgatgacgtaattcaccgttcgggcaattccagatggcagtcagtggattaatcacgcagttgactgccagcttgcgccacagctcggcgcgaatattgttatgccaggcaacgtcaggcaacacggtttgcaaaatatccgccagataactgtaatccccgtcctgttgccgtgccgggccaatatgcgtgataccgtttgccacatgaataatgacattgccgtcgcggcgggctgcatgggtggtggtgcccatcagtaatggctgctgaatgttttgcaactcttcgatggtgcccatgccgttgtgaattaacagtattggcgtagttacaggcagtgtggacgcgaggcttttgacggcatcggaaacctgccatgctttcagcgtcaccaggagcagatcgctggtggcgagaaaatcgggatcgttggcggtcagcgattcgttaaatatcgaaccatctgtctcaaccagattcacgctacaataaggttgcggtacgcgcagccagccctgaacttcatgaccctgtttgcaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcaggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaacgttgaagcctcatttgagctgaacgacgccagcaaaaccatcaaagtgttgagcgagtccgatttccaggtcaatcagttgctggatattctgcgtgccaagctgctgaagcgcggcattgaaggcagttcgctggatgtaccggagaatatcgttcatagcggtaaaacctggtttgtggaagcgaaactgaaacagggcattgagagcgcgacccagaagaaaatcgtcaagatgatcaaagacagcaaactgaaagtgcaggcgcaaattcagggcgatgaaatccgcgtaacgggcaaatctcgtgatgatttgcaggctgtcatggcgatggtacgtggtggcgatctcggtcagccgttccagttcaaaaacttccgcgattaatcgcgactatgtgcgttttgttcatgtcagatgcggcatgaacgcctgattcggcctacaaaggtttgtaattcagaaactttgtaggcctgataagcgtagcgcagcaggcaattcgccgcgttttttatgcctgacgaattgcctgttctatctcaaagcgattcgtcactttgctgtcgattttcacataagctgaatgttcttcttctgcaatcaacacttctttgatgccttcagtttctagcaaacgcacttttaacgcctcgtttgcggcaatgttcgccgggatttcaatgcgcaaactgctgacatacggcggttctttcatggtactggcgactgtcagccacactgcggccagcattgcgccagcgagaaataccccctgaccgtcaaacatgccgttaatccagccgcccagcgaaccgccaatcgccacgccaagaaactggctggtggagtaaacacccatcgccgtacctttgtaacctgctggcgactctttactgataagtgagggcaggagggcttccatcaaattaaacgccacaaagaaaagctgcacgccgaccaccagttgccagaactgcgtttgcgcgttccacaacacaatttccgcaaccacgatcaacccgacgcagaagacaaagacttgcttcattttgcgcttaacttcagcgtagataatgaaaggcacgaccgagccaaaggcgattagcattgtcgccagatagaccttccagtgttcagccgccgggaaccctgcatcagccagttgtccgggcagggcaacaaacgtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggtcgttgccagaatagcgatcatccagaacagcgcgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcggcggcaattgctccagagccttgtagcgcccggcccagaataattccccagatggagtcggaaagcgcagcgataacgctaccggcggcaaacaccgccagcccaccgacaattaatggtttgcgaccaatgcggtcggaaagcaggccaaacggaatctgaaaaacggcctgagtcagaccataaataccaatggcaataccgattaatgcttcgctggcaccttgcagagccatgccgtacgtggtcagaaccggcagaaccataaacatgcccagcatgcgcaacgagaatacggtccctaaaccccaggtcgcgcgcctctcacctggcgtcattttataatcgttcattaccacctctgttttaaattcgcgactagtgtaaagcggcaaacgaatggggtaaacatgcggattttttagtaaatatttcgagagggatatgtttctaatgctaagaaaaaaggtgccgtagcacctttttaatagagaggttttgttaccacacagcagccagcagcgtatgcgagtccggtaccataaaatcaacggacatcatcaccgagagggcagtgatggcgatgatagagaagccgaacagcttgcgcgcccagattctgtcatcagcaactttataaccgcgcagagccatacctaaccaccagacgctaaccgccgcggcgaccaccagatatttatacccagcgtaaccgccaagagagagcatcagcgtggcaacggcaaaggcgatgatatacagcgtgatgtgattcttcgccaccgaaatgccttttaccactggcaataccggaatgtttgccgcctggtaatccttaaagcggaaaatggcgatggcataggagtgaggcatctgccacaggctgaagatagccagcaggatcgctgcgccgctatcgaactcaccggttaccgcacagtagccgatcaccggcggcgcagcgccggagagcgaaccaatcaacgtgccgtagacagagtggcgtttcatgtacaggctataaacgccgacataaaccacaaagcccatcacccccagccagcaggccagcggattcgcgccaaaccacagcagcataaagccagcaatacccagcaacgtggcgtacaccagcgagacagcaggagagatcaggcctttcaccagcacccgattcttcgtcctttccatctttctgtcgatatccctgtcgatgtagttgttaaacacacaacccgacgccacaaccagtgacaccccaaccagcgtgtagataaacaggggataatcaatgctgccctttgaggccagcaggaatcccccaatcaccgagatcaggttgccaaagatgatgcctggtttcgttacttgcaggtattgcttaaacatcataaccgccgctcttagtgcatcatcatgttgtagttgaggttccacataatccagatggagcctacaaccaggatagcgatgattagcacggtgaagacaaacgccgtcatgttccagccttcatctgatttggtattcatgtgcaggaagcacaccagatgcaccagaacctgtaccactgccattgccaggattgttcccagaattacggccggagaggcagctcctgtcatcaccatccagaacggaatcaccgtcagaatgatcgacaggataaagcctgtcatgtaggtttttacgctgccatgggacgcgccgctgtgatcggtagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccagaagtgacgtgcagaccgtgcgtgccgaccagcgcaaagaacgctgacaggaagccgctgcgatccggacccatgccgttaacaatcaggtgatggaattcatagatttccatcccgataaatccggcaccaaacaaccaggtcaacgccagccaggagataacctggcttttgttgtttttgtacatggcgatagccgccatgccgtaggtgatggagctgaacaacagcaagaaagtttcaaccagaacgaacggcagttcgaaaatgtccttacctgtcgggccgcctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagctgcaatgacgatacctgcaccgctgtttttcggcatatgaatttcttcatagtggtcaggctttttatacgcttcgcctttctctttcatttcccagaatgcatcacgttcgtgaacgtgcggcactacggcaaagttatagaacggaggcggggaagaggttgcccactccagcgtacggccaccccacgggtcgccagtcaggtcacggttctggtcgcggtcgcgaatagaaacgtacatctgaataacgaggcagagaatacccagcgcaatcagtactgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtacggccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcattgtggtgataccaaagaaggcgtttacgttcgcgcccgcacccatcgtaaagaagtggtgcagccaaacgatgaacgacagcacggtgatacagacggttgcccataccagcgaggtataaccaaacagacgtttacgcgagaaggttgccgcaatttcggagaacacaccgaaaacaggcaggatcaggatgtaaacttccgggtggccccaggcccaaatcaggttgatgtacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatcttcagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtaaagatctgatcgtagtggtgaggtggcaggaagcccgcttcgcccgccgaggcaagagcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcgtgtgcgctgtgctcaccttctggctgggtcatgtccatgctcttaccgtgagccataaacttgttaattacatcggcaaacaagtctggtttcacgttggagaaatattccacctggttgtattcgctaggcgcggccagtttttcgaacgcagccatgtcagacatggtgttcggcgactgcttcgcttttgcgacccactggtcgaatgcggcgcgatccggtgttgcaatagctttgaacttcatgcctgagaagcccgggccgctgtagctggcggagataccgtcataagtgccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggtagcaatgccctgttccgggtagatgaagaaccatttccagtccatggaaaccacttcgatggtaatgggcttctcgtcgtgtgccagcggcttgctaggctcaagagcgtgagtggttttccaggtcagtactgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctgccaggtcacatatgttgcaaaacatatcaggttgattttaagaagctgttgcaaaagggcgttataacaaaaggggagtgctgaaggagtctgggcgggcaattggtataaccaatgtgaaataaaacaattatttaacaaataattatcattagagtgacaactgggtgatgagaaaataaagactcattagctgaatcgtgtaagaaaaatagaatttataaatggcgccaataatttccaaacgctaagccgcacaaaagaacaaatattaataagcgatactgatgtttatttagccgtaataattacggcgagtgattactacagctaaataatatttacagattacgtcagatgcgtttttcgtagcgccagataatccagcaaaccaccaagcacgacgccagaaagggcgactaaaaccccgacttccagcagagcaggcaggaaagagaagtgcgtcaaatccagcgcgtccatcgtcaatagcagtaaccacacggccaacaggctgacgcccgccgccagtgtccacatggcaaaggcataacctgccggatatgcggtacgggagataaagttgtcatttactcgtgtatattcaagcgtctggcggcaaaccagcagcaaaataagccctggtacggcagcggcgacggagaatagatagaatgtcgaccagccgtgtgcttcaacaaaccaacccgccacggggccgacataaactcgccctacagcagaaagcgctgagagcagggcaaattgagtagcggaaaatgacttattacatagcgtcattaacagcgcgacaaaggctgatgtgcccatcccgccacagaggttttcgaaaaagacggctgcgcccatgctgtagagatgcttatcagtaatcgacagcagccagtaaccggcgttagacgcaccttgtaaaatgccgaaaatcagcagtgcccggaacagtgacaggcgctgcatcaaaatcccaccgtacaatgcgccaacaatggtcgctagtaagccaagcgttttgttaaccacgcctacttcacccgcatcaaacccgacgccgcgaatcaaaaacgtggttgtcaggctcatggcgaatgcgtcgcccagcttatacagcacgataagaagcaaaataagccaggcattattgcgaccaaagaaatctcgcagaggtgcaacaaccgcttgttccagcgttttgggcacaggaatggtgtcggttggttctggtgcaagcaacgtcgcgataatacaggggatcaacagtgccgccattaaccagtacatgccctgccagcccagccatttatctgccagccacagggctaggccgccggaaaccagcatccctaaacggtaacccagcacgctgattgccgcgcccgcaccacgttcttctgccggaagcacatcggttttccacgcatcgaagactatatcctgggaagcagagcaaaaagcgatcaccactgccagcgccgccatccagcggagttgggtgcctggttcgagaaaacccatcgccgcaatggcgactaataacaggatttgcgtggcgagcagccaaccgcgccgccgcccaaaaaatggaggcgtgtagcggtccatcagcggtgaccagaggaatttaaaaacgtaagcctggcctaccagagagaagaaaccaatggttttgagatcgatattctcgaccgtcatccaggcctgtaaggtaccggatgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacgttgccctgggacacgtcagcatacagttggctaacgatgatttgcagattaaccgggccattcggaccaaccatgtaaccacgcgcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgccaacggcgaggggaagtgggtaaggcatgtaaattcatcatgttgacgaaataatcgcccctggtaaaagaaacactgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaattgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgttgctcagcgttatggcgcgtctgtacgccaggacgttctgggtgacctgatgagccgtaacttcattgacgccatcattaaagaaaaaatcaatccggctggcgcaccgacttatgttccgggcgaatacaagctgggtgaagacttcacttactctgtagagtttgaagtttatccggaagttgaactgcagggtctggaagcgatcgaagttgaaaaaccgatcgttgaagtgaccgacgctgacgttgacggcatgctggatactctgcgtaaacagcaggcgacctggaaagaaaaagacggcgctgttgaagcagaagaccgcgtaaccatcgacttcaccggttctgtagacggcgaagagttcgaaggcggtaaagcgtctgatttcgtactggcgatgggccagggtcgtatgatcccgggctttgaagacggtatcaaaggccacaaagctggcgaagagttcaccatcgacgtgaccttcccggaagaataccacgcagaaaacctgaaaggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgatcgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaaccagcaggcgtaatttacgcagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgcggtgagcgctcttttgatatctattctcgtctacttaaggaacgcgtcatttttctgactggccaggttgaagaccacatggctaacctgattgtggcgcagatgctgttcctggaagcggaaaacccagaaaaagatatctatctgtacattaactccccaggcggggtgatcactgccgggatgtctatctatgacaccatgcagtttatcaagcctgatgtcagcaccatctgtatgggccaggcggcctcgatgggcgctttcttgctgaccgcaggggcaaaaggtaaacgtttttgcctgccgaattcgcgcgtgatgattcaccaaccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttccgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccaccgtgtagaaaccggctccggcattggttttggcgcgacggtaaaagcgaagtccgacaaagcaagcgaaggcgagctgctggcgcaggttgaaccggaagatctgatcaagtttggtcttatccctgagtttattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgatccggcgcgtctggcggataccattgctgcacatatgccgctgaaactggctgacaaacagtctgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggtatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgctgctggatcagtacgcacgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtcgcgcaacaacgcgtggtgcgtgaggcgactatcgatgttaacgcgctggcggcgaagcagcctgtgaccgaacaggagattgccagctactacgaacaaaacaaaaacaatttcatgacgccggaacaattccgcgtgagttacatcaagctggatgccgcaacgatgcagcaaccggttagcgatgcggatatccagagctactacgaccagcatcaggatcaattcacccagccgcagcgtacccgctacagcatcatccagaccaaaactgaagatgaagcgaaagcggtacttgatgagctgaataaaggcggtgattttgctgcattagccaaagaaaaatctgccgatattatctctgctcgtaacggcggcgatatgggttggttagaagatgccactatcccggacgaactgaaaaatgctggtctgaaagaaaaaggccaactgtctggtgtcatcaaatcttcggtcggtttcctgattgtacgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccggttgccgacgctatctttaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcattggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggcggcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgcgttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacggcggtagaaaccaaagcggaagctcctgcagcacaaagtaaagcagcagtaccggcgaaagccagtgacgaagaaggcacccgggtcagcattaataatgccagcgcggaagagctagcccgcgcgatgaatggcgttggcctgaagaaagcgcaggcgattgtcagttatcgcgaagagtacggtccgtttaaaactgtggaggatctaaagcaggtgccggggatgggcaattcgctggtggaacgtaatctggcggtattaaccctgtaattaatttgcatagtggcaattttttgccagactgaagaggtcataccagttatgacctctgtacttataacaacaacgtaaggttattgcgctatgcaaacacaaatcaaagttcgtggatatcatctcgacgtttaccagcacgtcaacaacgcccgctaccttgaatttctcgaagaagcccgctgggatgggttggaaaatagcgacagttttcagtggatgacggcccataacatcgccttcgtcgtggtcaatatcaatattaactatcgtcgcccagcggtattaagtgacctgttaactattaccagtcagttgcagcaattaaacggtaaaagcggcatcttaagccaggtcattacactggagccggaagggcaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacctcaacccggttttctgcttcatcgctgccatcaccgtcggtttatcggccagataatgattcaaaccgttggcgcgtaaattacatgccgcacaatgaccgcaaccgtcgcctttaaagccgttatagcaggtcaacgtttcgttacggactaaatccagtttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccagtaattacggcttctgcttttacctgatacgcatatattgccgccagcgtcaggaacaaaatattacgccctgggacaaacgtattcgggataccatcggcttcaggttcataatcaggcaccggaatgctgtcacgcgtcaggctactgaccgccagctcgttgagcagggtgacatccagcaccttatgcgcgcgtgcccccagtttcagcgccagttcgcgtgccacgtcgatttctgcgcgatgccgctgaccgtaatcgaacgtcacgcaatggacttcatcatattgttgtaatgcctgcaccagacaggtggtggaatcctgacctccactgaacacaacgacagcacgtttcatagataatcctgcttgaacaataaaagcgttatggtaacgcctgcgattaacccggaccagctattcattgcgatggcgcgggaagccaggcttcggtaaattcaaaccagccgcgcggtgtcagtcgcacaccgttcacgccgggaggggcactaatgcgatagtgatagttgaacagcggcgtcagcgtcgcatctgtcattaactggctaaaaaccgctttcagggcattaaatcggttttcttcatcaggcattatttgcacggcatccagtgtcgattgtagatgtgcgtatgctggagcgtcgaaaacatgtggccacagcggatcgcagcgcagccattgctccagagtatattccggtgcttcgccaattaatctgtcgcccatcatgaggtctgcgtgtgcctgtagggtcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttgacttcatccggtacctgccaatgcggaatagtccagcctggcagtaatgcatgactggcggtgatcaggttttctccgacttctaacgtttgtaataaaccggattgatgaataatggagatcacttttcgcgcctgccagagggagagtcggggacttttgcgcaacgtcaaatagcaaaaacctaaactgatgccgctactgacctggctgacccgttgcagctcctccggtttgccgatggtgatttgcacgggatgccgacaactggttcccaaatctttttcgaaaagcggcggagttatccagtactcaaccgctttaagcagcggatgacgtaaatggtaataatcatggctttccaggcgcaccagctctgctgtgaattgtgttaagcgaaaaggacccgtgccgatcagtgggaattgcggatgcgccagatggctgcaatagctcgccagccggtgcgcaagccagtaatcagggcgatgtaaaaagaaggtcagacactgcggatgggtgacttcaatacgcttcacgctaataaataattgatccagtgctggcagttgtaacagcatcaataatcgctggtgtaagtgtgaggcttttactgcatcgccgttatgccagtgtagggttgaacgaagataaaagtcccagcgtaacccgtcagtagaggtttcccagtgatgcgctaaatcgccaatcgggcgctgagtattattatcgaagcgggtcaggccggaaaatatctgcccggcgagatgctgctcggcacggccgggcaaaaagcctggttgtagcggttcgagcgggcgatagtagggaatacgcaacgtgggtgtatcgttttgccattgtccgcccataaacggctgtaacagagtgcgcagctcacctggggccagttgcgccagctccagcacatcttgctgctttccggtttccagtgcctgttccatcatcgcattgcgtagcgattccggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggcggaaggttgccacagacgttgatactggttaagacggttgagcaatcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcccgaccatcatttaggtgagaaaaccctctctactttggcgcgactgcgtgaacgcgacattaccctcacttttgccacggggcgtcatgcgctggagatgcagcatattctcggggcgctatcgctggatgcgtatttgattaccggcaacggaacgcgcgtgcattctctggaaggtgaacttttacatcgtgatgatttacctgcggatgtcgcggagctggtgctgtatcagcaatgggatacccgagccagcatgcatatcttcaatgacgacggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttgtgtttttccgccacggattgcctcgaagtgctgccggtgggctgcaataaaggcgctgcattgacggtgctgacccaacatttaggtttatcgttgcgcgattgcatggcctttggtgatgcgatgaacgatcgcgaaatgttagtcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgtttaaaccgcacagaataaattgtcgtgatttcacctttaaaataaaattaaaagagaaaaaaattctctgtggaagggctatgttagataaaattgaccgtaagctgctggccttactgcagcaggattgcaccctctctttgcaggcactggctgaagccgttaatctgacaaccaccccttgctggaagcgcctgaaacggctggaggacgacggtatccttatcggcaaagtcgccctgctggatccggaaaaaataggcctcggcctgaccgcttttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagcgtgccggggctgtcggacgtcacttccagcttcgcgatggaacagattaaatacaccacttctttacccatcgaataaatatccagaatcaggtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgggtattgctgtttggtgcgtcttatcaactggctgttgaactgcgtgaagattattaccgtcagctaagccggcagcatcctgagttttacctgcgtcatcgcaccggtgacctcatggctcgtgcgaccaatgacgtcgatcgcgtcgtgtttgccgccggagaaggggtgctgacgctggtggattcactggtgatgggctgcgctgtgttgattatgatgtctacgcaaattagctggcagttgaccttattttccctgttgccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgtcaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtagttttagccaactgtggccgactctcaagcgcctgttagcgtacggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgctggtggtaatggtgatataccagcgttacagcacgccgattgtccgtcgtgtgcgcgcctatttggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaaacttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaagggcatgccgagctgtaccggggggcggaatacagcgtcaatttcctgccaaaagtaaaaattgatgtggcgattgctgatgaccaactcgatgaagtgatcgatatcgtcagtaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgcttccgggactggtaatggctgcacctgcggtggccgataaagccgacaatgcgtttatgatgatttgtactgcgctggtgctgtttatgactattccggggattgccctgttttacggtgggttgattcgcggcaaaaacgtgctgtcgatgctgacgcaggtgacggtgacatttgcactggtctgtattctctgggtggtttacggttactcgctggcgtttggtgagggcaacaacttcttcggcaacattaactggttgatgctgaaaaacatcgaactgacggcggtgatgggcagcatttatcagtatatccacgtggcgtttcagggatcgtttgcctgcattaccgtcggcttgatagttggggcgctggcggaacgaatccgcttctcagctgtgttgattttcgtggtggtatggctgacgctctcttacattccgattgcgcatatggtgtggggcggtggtttgctggcttctcacggtgcgctggatttcgcgggtggcaccgtggtgcacattaacgccgcaatcgccggtctggtgggcgcgtatctgataggaaaacgcgtgggcttcggtaaagaggcgtttaaaccgcacaacctgccgatggtcttcaccgggactgccattctctatatcggttggtttggctttaacgccgggtcagcgggcacggcgaatgaaatcgcggcactggcatttgtgaatactgtggtcgcaacggcggcggcaattcttggctggatcttcggtgaatgggcgctgcgtggtaagccttcactgctgggggcgtgttctggcgcgattgccggtctggtcggcgtgacgccagcctgcggctacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggcattgtcggctgtatcatgaccgggatttttgccgccagctcgctgggcggcgtgggcttcgctgaaggtgtgacgatgggccatcagttgctggtacagctggaaagcatcgccattacgatcgtctggtccggtgttgtggcatttatcggctacaaattggcggatctgacggttggtctgcgtgtaccggaagagcaggagcgagaagggctggatgtcaacagccacggcgagaatgcctataacgcgtaacaagcactgcaaaaaacagccggacggttttcacctccggctatttttttaattgtgattacgcatcaccccttcctgaacggtcgaggcaaccagtacgccgtcttgggtataaaactcaccgcgcacaaagccacgtgcgctggacgccgaggtgctctccacgctatacagcagccattcattcaaattaaacgggcgatggaaccacatggaatggtcaatggtggcaatctgaatccccggttcgagaaaaccgatgccgtgcggctgtagagctaccggcaggaagttaagatcagaagcgtaaccgagcagatactgatgaacgcgcaggtcatccggcacgctaccatttgcgcggatccacacctgacgatgtggttctgcgacgtgacctttcagtgggttatgaaactccaccggacggacttccagcggacgatcgcagatgaatttatctttcagcactggcggcagcaggtgcgccagcgattgggcgatttgcgtttccgaagggaggccatcaggcgctggcgcggacggcattgttttttgatgttcgaaacccgcttctggtgcctggaaagaggcagtcatataaaaaatcggtttgccgttttgaatagcagcaacccggcgggcgctgaagctgttaccgtcacgcagcgtttcgacatcataaataatcggcttcttactatcgccagggcgaagaaagtagctgtgaaacgaatgtaccagccgctcttcagggacggtctcttttgcagcatacaaggcctgacccacgacctggccgccaaacacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgctactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaaatgaatgaaactcgtgcacatggccagtggtttagcggttgcgattgcgttggcggcttgcgcagataaaagcgcggatattcagacgccagcaccggctgcaaatacgtctatttcagcaacacaacaaccagctatccagcaaccgaatgtctccggtaccgtctggatccgtcagaaagtcgcactgccgcctgatgctgtgctgaccgtgacactttctgacgcgtcgttagccgatgcaccgtcaaaagtgctggcgcagaaagcggtgcgtactgaaggtaaacagtcaccattcagctttgttctgtcatttaacccggcagatgttcagccgaacgcgcgtattctgttgagtgcggcgattaccgtgaatgacaaactggtatttatcaccgataccgttcagccggtgatcaaccagggcggaactaaagccgacctgacattggtgccggtacagcaaaccgccgtgccggttcaggccagcggtggcgcaacgactaccgtaccttcgacttcaccaactcaggtgaatccgtcttcggcagttccagctcctacgcaatattaagcgacgttaaccctctccgcccggagagggttagtagttccagcgataacgctgcaagtcgatttgcccgcttcccgataccatcacaccttctgccagtaatgcctgtcgctgacgctgtaaatccggtccggttagcgaaattgtgccgtggcgattaaccacccggtgccagggtaaggtgctgccttcagggagacgctttaacacaccgcccacctggcgcgcggcgcggggcgatcccgccagtttcgccacatcaccgtaagtggtgacatagccttcgggaatagcggcgacgatttgccagacgcgttggggaaatgaatcttctttttccatcttttcttcctgaggtaatttttcagcataatctggaaaaacgcccgagtgaagtcgcattgcgcaagaaaccagcatctggcacgcgatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccacaactgacgtcgcaagaattgtctggctgcgcagtacgcttcggaggtatgtctgatgaagtatgttgatggttttgtggttgccgttcctgccgataaaaaggatgcctatcgggaaatggccgctaaggctgcgccattgtttaaagagtttggcgcgcttcgtattgtcgaatgctgggccagcgatgtaccggatggcaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggcggattcgagtcaatcatcgacgaataggtagcgtgacgggctgtgcggcgtgccgtcagcccaaaaattcacaaatgttgctcggcccagcgtaagaaatcttctttcggtaatgccttgctgtagagccagccctgaccgtagtgcacgccatgctggcgtaaccactcttcttgtttactggtttcgattccctccgctaccattttcagtttcagtgtttttgccatttcgatgatatgcggcgtgacatttttatattccagcgcatcaacgaaagatttatcgatcttcagaatgtcgacatccagatcctgtaaataacttaaacttgaataccccgtaccaaaatcatcaagataaatttcatggcccgcctcccggtagcgagaaattatcggggcgctggttttcggatcggcaaactcgcgttcagtgagttcaagcgcgatctgtctgggattaacctgatagtgattgatcatgtcacgcagcaattgcgggattttttccgaggtgagcacgggggattcaagattgatcgaaatatgctgctgtggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactgaatacggcgcaaaatacgcagcacaaacatcgctgccagcaggccaatcaccaacccgagcggtaaccaaataaagacttgccgatgccagcctttctgcaacattttcgttgaagcccatgtgatgatcgaaatattcatctccggtaagggcaggatatcgtaaatgattccattattttcgatatgctcaccgggtgttttttgtagcctggtaataattccctgagcaatttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacggataatgcctaaatcgttatgcgatgttaaccagacacgataaccatctttcgaaattttacctggctcggggaaggtatcgggcggactttcatgctccagagacgaacactggggaacgttgttatcgatataagccacttcctgaatatagcgataactgtaagatacccgacgcatttccatgagatgggcttcgctacaggcagcgccttgccatctttccagctcctgcagcgcatctttcccttgtgtcgccaccttattggctcgaatagcgacgcgggaggaataggtatccagctcttcaataaacgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggctggagataaggaggtagagctggtatttcatgaagtgatgggtggaaacgatcattgtcatttgaccaggcgcagagctttacgcctggtatgtaaccctaacttaagatgttgattcggcgcgagcgagggtaaaaatatcgtaaaaagacagttcacctttacggacgatcattttttgcagttgttccttatgaacatccgcgacacgcggagagttcaagatggcttcaaccagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgacagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtggtatctgcaactttccagggaacaccctattttaacgtgggaatagtagaggggaagtaacagatctaccacaattttgcataacagttgcgaaaaaccgattacaattttttaattattctggctggattaccgcccacgacaacgttgtccgggacatcttttgtgacaactgcacctgaggctaccacgacgttatcaccaatggtcacaccagggttaatgaccgcgcgtccgccaatccagacgttattaccgatggtgacgggtttccccagttcagcaccgctattacgtgctacagggtcgatgggatgtgttgccgtgtagatatgaacgcctggtgccaacatacagttatcaccgatgcgaatagggcagacatcaagcatcacgcaatcgaagttggcgaaaaaattattaccgagaaaaatgttatagccatagtcacagcgaaacgttggctcaatataagcctctgtcacctgaccgaatagatcagcgagaatttgctggcgtaatgtgtgctcttccgccagggaatgattgtatcggtgaataagctgacgagcgcgcaggcgatcgcgagataacgtctcatctgccgagcgatacaactcaccagcaatcatcttttctttttctgtgctcattactgacctccggttgctgaaaatgcggcaacacagtaagacgaaaagtcagtgaagagaacgttcccattacatctgtgtgataaagatcacatagggtatgtcttcatggcgaaaaagtataaaattcttaataaacagccggttatagctccgaaagcgaattatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctggcaacgacgtaaacgcattaaataatcggttttcgttaaaggtttttcggacatacttctacctatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgtttacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgccctctcgtttgttagcttaactataagccactctttgcaggttttcatcgcattattacgaaaaattacaattaggaaggaagcgggacaggactcactttttcatactagcactaacccgcagcaggtaaaagcagtttgctcgaactattcataacatttcaggattatcgccagatgaaattggtgacactaataccaggattgctctgaatatgacgtaataaccgaggaatgaataaagaattaccgcaaataattaagaatagcctctaaatgattatggattattaaatctattagcgctacttaatataaattaactaacaatcagtattttttatgaattttatccgtggttaatactggttttcgtatgagatcctgagttggtggttcaattactccttaatgttcgtaggttatgcataaaaaaggccgcttacgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccagcgaggtcatcaggatcggacgtaaacgcatccgcaccgcatcaagcgtcgcttcaatcagacctttaccttctttatccatcaagtctttggcgaattcgacgataaggatcgcgttcttcgccgacaacccaatggttgtgagcaggcctacctggaagtaaacgtcattggtcaggccacggaaggtggcagccagcaacgcaccgataacccccagcggaacgaccagcataacggagaacggaatcgaccagctctcgtacagcgccgccagacacaggaacacgacaatcaacgaaatcgcgtacagtgaaggtgcctggttgccggagagacgttcctgataggacatccccgtccagtcatagccaacaccggtaggcagtttgctcgccagttgttccatcagctccattgcttcaccggtacttttacccggtgccgcctggcctaagatttccatggatggcaggccgttgtaacgttccagacgcggcgaaccgtactcccaacgagaagaggagaacgccgagaatggcaccatctgaccatcagcagcacgaacataccagtcgccgatatcatccggcagcatacggtatttcgcttctgacatgacataaactttcttcacacgaccgcggtcgataaagtcgttcacatagctgccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcagtacccagttccacgattgcgggcaggttaaaggcgaaaaccatcgcatctttgatttgcgagaaagcgcgtgttgcacgcatggtaatcgcttcaactttgttttcttcgcccggacgatcggcccagtccttcaaggaaacgaacgcaataccggtattctgaccacgtcccgcaaagccgaagccgttaacggcgaacaccgactcaacgttgttcttttctttggtcagatagtaatgcgttacctcattgagcactttctgtgtacgttcctgcgttgcacctgctggcagctgaaccatggtcataaacacgccctggtcctcatctggcaagaaggagcttggcagacgcacgaacagataggccatgccgaccacgatgatcagatacagcaccaggtaacgccccgtactgcgcagaataccgcctacgctgtcggtgtagtggtgcgtgctcttctcgaacatgcggttaaaccagccgaagaagccttttttaccttccccgtgatcgcctttggcaatcggtttcagcatggtggcacaaagagctggagtcaggatcaacgccaccagtaccgacagcgccattgctgaaacaatggtaatagagaactgacgatagatagcaccagtagaaccgccaaagaaggccatcggtacgaataccgccgacagtaccatcgcgataccgaccagagcgccctgaatctgccccatcgacttacgggtagcttcttttggcggcaaaccttcttccgccataacacgctcaacgttttctaccacaacgatggcgtcatccaccaacaggccgatggcgagcaccatcccgaacattgttagcgtgtttatcgagaagccaaaggcggcaaggacggcaaaggtcccgagcaataccaccggtacggcaatggtcggaatcaacgtcgcgcggaagttctgcaggaacagatacataaccaggaacacgaggatgatcgcttcgaccagcgttttaaccacttcgtgaatagagattttcacgaacggcgtggtgtcgtatgggtaaacaattttcagacccgacgggaagaacggttccatcttcgccagttcagcacggattgccgcagcggtatccagcgcgtttgcaccggtcgccagcttgatccccagaccggaagccggttggccgttaaactctgcgatgatgtcgtagttctcaccacccagctcaatcttcgcgacgtcacgcagcagcacgcgggaaccatcctgattcactttcagcaggattttgccgaactcttcagtagaggtcagacgcgtctgagcaataatagaggcgttaagctgttggcctttcaccggcggcgtaccaccgagctgacccgccgcaacctgggcgttctgcgctttgatggcggtaatgacatcaaccggcgttagctggaatttgttcagctcattcgggttcatccagatacgcatcgcgtactgtgaaccgaacaactgaacatcacccacgcccgacgtacggctgatggcatctttcatattcgccgccacgtagtcggagatatcctcctgcgtcatggtgccatcggtgttgataacgccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccggggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccaatagcctggcttgcaacgatcggacgggtttccactttgtcatccgcgccaactaccagtacggtggcatcgccacgcggcgtacgggttacgccctgttgcgggactaaaatagcgtttggattaagcccttcttccagacgtgcgcgcacgaacatacccggcagcagagtgtgatccgggttcgggaagatagcgcgtagggtgatagacccagtggtctgatcaacggtaacgtcagagaattccagcgtaccgtcctgcgggaacttaatgccgtcactggtgatcagtgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgttcgacttaccaatgcgaccgctaatcggagaggtgactttggtgtaagccagattgatccgcgcagtttcaacggcagctttcgccgcagttaccgcagcattcgcctgttgcgcatcagccagagcctgatcgtactcttgcttactgatgtactgagtaccgagcagtttctgataacgattcaccgtcaattgcgcgatattggctgcagcctgggctttcgccagatcacctttcgcactgtcgtatgtcgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggcgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgaatccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgttgccatcttactggagatgtatctcctgtgccccacgcttcgtaatcctgccactaacgaataaccctgaatctgactccaggatttttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcgcaacttgactcactaaataaacaaaaagatctttctgctcaggacaaactggtgcagcaggatctgacagatacattagccaccctcgataaaatcgatcgcataaaagaagagacagttcagctacggcaaaaagtcgctgaagcgccggaaaaaatgcgccaggcgaccgcggcgttaacagcacttagcgatgtcgataacgacgaagaaacgcgcaaaattctgagcacgctgtcgttgcgccagctggaaactcgcgttgcccaggcgctggacgatttgcaaaacgcacaaaacgatctggcgtcttataacagccagctggtttcgttacagacgcagcccgaacgcgtgcaaaatgcgatgtataacgcttcgcagcagctgcaacaaattcgcagtcgtctggatgggactgatgtcggcgagacagccttacgtcccagccagaaagtgttaatgcaggcccagcaggcgttgctgaatgcggagattgaccagcagcgtaaaagcctggaagggaacaccgtcttgcaggataccttgcaaaagcaacgtgattacgtgacggcgaacagcgctcgtctggagcaccagttacaactgttgcaagaagcggtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagcctgctgttgtctcgtatcctttaccagcaacaacaaacgctgccctcggcggatgaactggaaaacatgaccaaccgcatcgcggatttgcgtctcgaacagtttgaagttaaccagcagcgtgatgcactcttccagagcgatgcgttcgtcaacaaactggaagaaggtcacaccaacgaagtcaacagcgaagttcacgatgcgttattgcaagtggttgatatgcgtcgcgaattgctggatcaactcaacaaacagttgggtaaccagctgatgatggccattaacctgcaaatcaaccagcagcagttaatgagtgtgtcgaaaaacctgaaatccatcctgactcagcaaatcttttgggtgaacagtaaccgtccaatggactgggactggatcaaagcgttcccgcaaagcctgaaagatgaatttaagtcgatgaaaatcacggtgaactggcaaaaagcctggcccgccgtttttatcgctttcctcgctggtttgccgctgctgttgattgccgggctgatccactggcgtctgggctggctgaaagcgtatcaacaaaaactggcttccgctgtgggttccctgcgtaacgacagccagctcaacacaccaaaagcgatccttatcgacctgatccgtgcgctgccggtgtgcctgattattctcgcggttggcctgattctgttgaccatgcagctcaacatcagcgaactgctatggtcgttcagcaaaaaactggcgatattctggctggtgtttggcctgtgctggaaggtactggagaaaaacggcgttgccgtacgtcacttcggcatgccggaacagcagaccagccactggcgtcggcaaattgtccgcatcagtctcgcattgctgcctatccatttctggtctgtggtggcagaactttccccgctgcatctgatggatgatgtgctggggcaagcgatgattttcttcaacctgctgctgattgccttcctggtatggccgatgtgccgcgaaagctggcgtgataaagagtcgcacaccatgcgactggtcaccattaccgtgctgtcgataatcccgattgcgctgatggtgctgactgctacaggctacttctacactacgctgcgtctggcaggacgctggattgaaaccgtttatctggtgatcatctggaacctgctgtaccagacggtactgcgtggcttaagcgtagcggcgcggcgtatcgcctggcgtcgtgcgctggcgcgtcggcagaatctggtgaaagagggcgcagaaggtgctgaaccgccggaagaacccaccattgcactggagcaagttaaccagcagacgctgcgtattaccatgttgctgatgtttgcgctgttcggtgtcatgttctgggcaatttggtccgatttgatcaccgtgttcagctatctcgacagcatcacgctctggcattacaacggcactgaagctggcgctgcggtggtgaaaaacgtcaccatgggcagtctgttgtttgcgattatcgcctcaatggtggcctgggcgttgattcgcaacctgcctggtttactggaagtgctggtgctctcgcgactgaatatgcgccagggcgcgtcgtatgccattactaccatccttaactacatcattattgctgttggtgcgatgacggtgttcggatcgctgggcgtctcttgggataaactccagtggctggccgcagcattatccgtaggtcttggttttggtttacaagaaattttcggtaacttcgtctccggtttgatcattctattcgaacgtccggtgcgtattggcgatacggtaaccattggtagcttctcggggacggtaagtaagatccgtattcgtgcgacaacgattaccgatttcgatcgcaaagaagtgatcatcccgaacaaagcgtttgttaccgagcgtctgatcaactggtcgttgactgacactactacgcgtctggtgatccgtctcggcgtggcctatggctccgatctggaaaaagtgcgtaaagtgttactgaaggcggcgactgagcacccaagggtgatgcacgaaccaatgccggaagtcttctttacggcatttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgatgacccgacgccagcggtagggtaaaaacgaaagggggcaacatttagttgccccgagattgctaacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccgcaaccttaggggacatttagcgaccccatttatttctcacttttccgcctcatcatcgcgcgttaatttcttttcataatcacgctttacaatatccagcgcgcgcagcacggtactggcagggatctgattttcctccagcagcacaatcaaatcgacagccagtttgacatcgtcaggggcattttccagtgacatattctctccattgctagcgggttaaacgcgctaacctgttttcgattttttccagcgcatggcggcagcgtgccaggcgcgcttcataggcttccacttcacgatgcagcgtttgctgttccacgagatcggtcacccgcgccagacgggctctgcgttcggcaaccatctcacgtagccgccgctcaaaatcctgatgctgaatacgtttacgctgccagcgggcaattttcggtggtgcactgtcccactcgcgcaatgaccaggcggaggcttcacgcgcgatggcttccagttgtgccgccagatgttccgccagccaggccacttgcggcagctgttgctgctcaactgcatgacgaagcgcagccagattatcgcccgcctcgtcgagacaagcctgtagtgttgtcgcacgagtctgaaaaagatgcctgtcgaaacgagcacttagcgtggcgaactgtgacaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgtcaaaccgcgggcgattttgcttattttgctcacgtttgccatttctctgtggttcgtccagatgccatgggtgcgcatcatgttgctggtaattctcgcctgtttgcttttctatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgtttaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaattatcgccagtcttgtgctgcccacgctacggacagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccgttctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggccactgcgccgattgccgcactttcaccgaacaggaagtctgtaacatctgttcgaatccgcgtcgtcaggaaaacggtcaaatctgcgtggtggagagtccggcggacatctacgccattgagcagacggggcagttttcaggtcgttattttgtgttgatggggcatctgtcaccgctggacggcatcggtccggatgatatcgggcttgatcgtctggaacagcgtctggcagaggaaaaaatcactgaagtgatcctcgccaccaaccccacggttgaaggtgaagctaccgctaactacattgccgagctttgcgcgcaatatgacgtggaagccagccgaatcgctcatggcgttccggttggcggcgagctggaaatggtcgacggcaccacgttgtcacactcccttgccgggcgtcataagattcgtttttaagcaaacgagagcaggatcacctgctctcgcttgaaattattctcccttgtccccatctctcccacatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaatggcgtcttctgggaatcggctggcgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctgatgtaatgccggatgaccttcgtgtcatccggcatttttcttttcatcatctgcactttccgcaaattatctcgccattaaccgtttcagccccaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaattcgaaagcgcgcacggacagtcccctcgccccctcggggagagggttagggtgaggggaacaggcccgcacaagcaaacttatcagcaatctcaggccggatattcattcggccttttacaaaaacctcaatctgcgctattcctttttctgatttgacctctcacagcaattagttcttcttcctcacttttccgctacaattatcaacaagttgaatcgataagaggcggtaatgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgccagcaacagcaggcgctggcacaacgtttaccggagatgcccgtagcgctgggaatgagctacggctcgccatcactggaaagcgccgtagatgaactcctggcagagcatgtagatcatattgtggtgctgccgctttatccgcaattctcctgttctacggtcggtgcggtatgggatgaactggcacgcattctggcgcgcaaacgtagcattccggggatatcgtttatacgtgattacgccgataaccacgattacattaatgcactggcgaacagcgtacgcgcttcttttgccaaacatggcgaaccggatctgctactgctctcttatcatggcattccccagcgttatgcagatgaaggcgatgattacccgcaacgttgccgcacaacgactcgtgaactggcttccgcattggggatggcaccggaaaaagtgatgatgacctttcagtcgcgctttggtcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgccggcgggaaaaaatatgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcgtgcctgggtagagtttgaactcacagggctgctgatgcgccgctaacgtctggtaaagcagacggctgtcatccagcagcggatcgaactccgccccggcaataaaacagggcggaacttcgcgagtgagatcattattaaacagacagtaatacggcgactcgcggtccgcgtcgttgcttaaatatgcctcttcgtacatctgcaaatcctgttgcgttaagccatcccagacaccgcccaacagacgacgagtcacggaatcccgtaatccgtaaagcccataccacagcaaaacgcccgcaactttaccgcaatcgatctgtttatcacgcaaccacaacgcactggcgagcgccagcatggcacctgcggaatcaccggcaaagccaatgcgggacatattgatttgataatcctccgcctgctggtggaaataacaacaagcagccacaatttcctctatcgcttgcggaaaacgcgcttcaggtgaaagggtgtaatcaataccaatcaccgtacattggctgtagcttgccagcaggcgcatgatgcgatcgtgggtatcgagattgccgagaataaaaccgcctccatgcaaataaaatagcgtcgctgggctatctggctgcggacaaaagagacgtgtttccacctgcccatattttgttggaaccatgtaagctctggttgccatttctggagcgcccgcattccagaatcggcgctcaagcgtgtaatactgtcgttgctcagcaatcgttcccgttgcgggccagggcggtaaatccggctgaagagtattcacaacggtcttcatttcagcagaaataaggtccagaacaggtagtttgttttccggcttcatacaaaaactcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaatttattgagcgttatggattaagcgccgggcattcactggtgattgaggatgatgtagccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagttatgcctatcgttacctgtgtaacacttccagccgtaccgatcttaactatctacaaggcgtggatggcccgattggtcgttgctttacgctgattggcgagtccggggaacgtacctttgctatcagtccaggccacatgaaccagctgcgggctgaaagcattccggaagatgtgattgccggagcctcggcactggttctcacctcatatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagatcacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggcgctatagcggaattcaaccagtatgagtttagccgcgccatgcgccacaaggattgccagaatccgctgcgtgtatattcgcacattgcgccgtacatgggcgggccggaaaaaatcatgaacactaatggagcgggggatggcgcattggcagcgttgctgcatgacattaccgccaacagctaccatcgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcatttggctctcgatgcctgatgcgacgctggcgcgtcttatcatgcctacatatttttcatattttacatccggcaaccaccgtttaccccgtcaccacctcacccgccggtggcgtttccagcagttccagcatggtacgggcgatttcacgctcgcccatcactacctgattcgcaccacgttcggtgatatacgccacttcatcgtcataatgggcgcgggcaataatctcaatatccggatttttcgcgcgggcagatgccacaatctcacccgcttcataaccgttgggaatcgtcaggatcagccattttgcacattccagatgcgccagttgcataatttcttcgttcgccgcattgcccaatactgcgcggaccccgcgctctcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcccagtcccgccaggataaacgcgaactcaccaatctgcgccaggctggcggcgatggttaatgccgtacgttgggagtgaccaaacagtcgcaccaggaaaaatgcggctaacgacttaccaaacagaataatcgccagcgtcgccagcactgccagcggttgctgaatcagaattaacggatcaaacaacatcccgacggagacaaaaaacagcaccgcaaacgcgtcgcgcaatggcagcgtatcgtgggcggcacggtgactcagttcagactcgttcagtaccatcccggcaaagaacgcaccgagtgcaaaggagacatcaaacagctctaccgcaccaaaggcaacccctaacgccagcgccagcaccgacagggtaaacagctcgcgagaaccggttgccgcgctgcgtgccataatccacggcaccagacggcgacctaccagcatcataatggcgataaatgcgatcactttgccgatggtgatccccatatcgactgcaagagtggcaaagcccacatcgccctgttccatcattcctgccactgcgggcagcaacaccagcgtcagaaccattaccaggtcttccacaatcaaccaaccgatggcgatttgcccacgctgactgtcaattaattgccgttcttcaagtgcgcgcagtaacaccacggtactggcggtggaaagacataaaccgaacacgataccggtcattaacgaccagcccagcacggcagagagcgccatacccagcagcgtcgccacggctatctgggcgatcgcaccgggaatggcgatggcctttaccgccatcaaatccttcagcgaaaagtgcaaaccgacgccaaacatcaacagaatgacgcccagttcagccagttccggggcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgttcatgaataattattgaattttgcagaaaaatggaattagctgcaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcctggaagcagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgcccaattttatcccctacaggcccgccgatcaccgtacctgccgcaacggcaaacaggaaggcaaacagatgaagctgagcattctggatagataatccgaatttttgcatcagataaaaggtgtaatagctgctgatgctcgccatatagaaatatttcgagaaaatgaggattaacagaatgctgaccgccagtacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaagggtcccagggaactgccaaagttgccgccgacctgaaagatagattgcgccaggccatgccgcccgccggaagccatacgggccacgcgagaagattccggatgaaagaccgatgaaccggtaccgaccagcgccgccgccagcagaactgcgccaaaactgcccgccagcgcaagcagcaccagaccgcttaaggtaaagcacatgccaattggcaacgaccatggcatcggatatttatcggtccagtagccgaccactggttgcagtagcgaagaggcgagctggaaggtgagggttatcatgccaatctgcataaatgtcagagaaaattctgactgaagcagcggataaatcgccagaatcagcgattggatcatgtcgttcagcagatgtgagaggctgatagcacctaaaataccaaacgatgttcgggccttggtcgttgacgcagccgcgcccgccacaggctggggttgttcactcattgccataggaaagtcactttttcagggttgcgatgtaaagaatgatcttatttgtgattattaccagactaacatacctgtatgcgtcgtctgaaggaagtctcaacgccgaatacagaatttctaatctggatgcagatttatcttcaccggacgcagacttgtctatgatgtcgcgtcatactatttttcaacacgttgaaatcaggtcagggagagaagtatgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaatccgaaagtgccggatgtttgcatccggcacaatgcttaatcgcggcgggcgatatcagcaaatttggcatcgaggatctttgccagatcgcctgccgccagttcgatatccagtccgcgcttgccgccggaaacataaatagtggcaaattcttgtgcgggggcgtcgataatcgttggcagacgttttttctgccccagtgggctaatccccccaaccaggtatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgccaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatttgcggcaaattcccttctccatacaggtgtagtgcaccgaccgcgaccacatatcgccccggcggcatggcgcgtaatttatcccgccaggcgagatttcgctgatgcatcagcacatcgtacagcgactgactgaacgtattgggcagcgttatatcattattttgcggcggtgcattcagccaccagctcatcatttgttgcagcaaccgtgcgttggtatgccagtgggtcagcgtatcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacagcggttgggtagaaaagagtgagggagaaatgcccatctcctggctaatgtgctgcaggttttggagttgctcctcgctaatgcgctcttccagcgcctcgcaggcaggcaaattagcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccggggagggtgatatcgatggcaggccaggtgtaatgattaccgcgcagcgcggcccaaagcgtttttacccggtacaacagatccatacgacctccctttgtgaaatatcatgctagcgcgcggtgagggatggcgcaaatggagttggagacttgtttaatgtgtttgtatgattcagtatgttcttgcatcgctattcacaaggaagcaacagttaaaaaccatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcactactgagatggcatttcgtctggcgaaagtttttgataccacagtcgatttttggctaaacctccaggcggcggttgatctttgggaagttgaaaacaacatgcgcacccaggaagaattgggacggattgaaacagtggctgaatatttggcacgccgtgaagagcgtgcaaaaaaggtcgcgtaaggccaaaacatcgcttcatctcgtaggccggataaggcgttcacgccgcatccggcatccgagcaccattgcctgatgcgacgcttacccgtcttatcaggcctacaaacttgtgcctgaaccgtaggccggataaggcgtttacgccgcatccggcatccgagcaccattgcctgatgcgacgcttacgcgtcttatcaggcctacaaacctgtgcctgaaccgtaggccggataaggcgtttacgccgcatccggcagtcatgcgtcgatgccaaatgcgccaccctaaagcagcgcatccgcaatgatgtacttattccttcggtttaaaccgcagcaaccggttggcgttactcactacggtaatcgacgagagcgccattgccgctccggcaactaccgggttaagcagtgttccagtgaacggccacaaaataccggcggcgaccggaataccgatactgttgtagataaacgcaccgagcaggttctgcttcatgttgtgcagcgttgcgcgggaaatagcgagcgcatccgcaacgcccatcaggctatggcgcatcagggtaatcgccgcggtttcaatggcaacatcactgccgccacccatcgcaatgccgacatccgcctgagccagcgctggcgcgtcgttaatgccgtcgcccaccattgccacctgacgtccttcactttgcagatgtttgatcgcttcggctttaccgtccggcagcaccccggcgatcacctcatcaatccctgcttctttggcgatcgcattggcggtggttgggttatccccggtcaacatcaccagacgatatcccgctttatgcaggcgttgcagcgccgccacgctatcactacgcaacggatcgcgtactgccagcagggctaccgctttcccgtcaaccgccagcagcacaggcgttgccccttgcgatgcctgagcagtaatctccgcttcgatagctttggtaccaacctgttgctcatttaacagcgcctgattgcccagcaataacgcatgaccttcagcttcaccgctcacgcccagcccgcgcaatgtgcggaaaccgttgacctgcggtagctgcatatcacctgctttatcgaggatcgctcgtgccagcggatggctggaaccttgctccagtgccgccgccagacgcaatgcctgcgcttcatcaacatcagcaaatgttttcactgcgacaacctgcggcttcccttcagtcagcgtcccggttttatcgaacactacagtgtcgagtgtactggcgcgttgcagcgcgtcagcgtcccgcaccagcacgccaaactcagccgcccgcccgacgccggaaataatcgacatcggcgtcgccagccccagcgcacacggacaggcaataatcagtaccgtggtggcaatcaccagggtatagacaatctgcggtgccggaccaaagaaataccagattgccgcactgacaagcgcaataaccaccactaccggcacaaatacggctgagattttatccgccagctgaccgatttctggcttgctgctctgggcctggcgcaccatgcgaatgattcgtgacagcgtagtatggctgccaaccgcactggcacgaaacagcacactgccgtcctgtaccactgtcccggcatggacgctatcgccttcgcctttttgctgcgggattggttcgcccgtcagcatcgcttcatccagccatgcttcgccctgggtaatctcgccatctaccggcacgcgatcgccggtcgtcaggcgcagcaacatacctggctgcacttctgccagaggcacgcttttttcaccttcgtcagtaaccaggcgtgccgtcggcggggttaaatcgagtaacttttccagcgccttagaagaacgctggcgtgcgcgcgcttccagcatatggccgagattgatcagaccgataatcatcgcgctggcttcgtaataaagatgtcgcgcttccatcgggaaccactgcggccacaggttgacgctcatcgaatagagccacgccacgccagtacccagcgccaccagcgtatccatcgtcgccgcaccgttcagcaggcttttccatgcactgcggtaaaaatggccgccggcgaaaaccatcactgccagggttatcaggccgataaccaaccacaggctgcggttgtcagcggtgaccatcatgttatcgccgatcatcccccagaccatcaccgggatacccaccgccagtgcgacaattgcctgccagcggaagcgcttcatcgtagcgacggcggtttcttgctggcgctcgcggcgtttagcgtcatcttcaatcgcttccgcgccgtagcccgctttttccaccgcctgcactaaatcttgtggggaggcactgcccatcaccagcgcagtacgctccgccaggtttacccgtgcctgagtgacgcccggtacgctttgcagcgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgctcaacatccggacgctgttcaagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcctgaaaatcggcaccggggtgaggaattacctcccgcatctataaaaaggagttaacaaaagatgttagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatctgttgaaaccctttaacaaagcacaggaggcgttgcgcgaacgatgaacatcagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacggcaggtgggctttaacctggaagagagcggcgagctggtgaatctgtttaacgacccgcagcggcacagcgccgacgtcaaacggcgcacgctggagaaggtggcggagatcgaacgacacattgaggagctgcaatccatgcgcgaccagctgctggcactggcgaatgcctgccctggcgatgacagcgccgactgcccgattatcgaaaatctctccggctgctgtcatcatcgggcagggtgattaagacgagacggctcggatatgtagggttatcccttctatcgcaatgacttcaacatgcgtacctgcaccgagatcctcgctggcgctgacaggccatgaactgtcaccgacgcgcatatgaccgcgcccgttgaccagcggagattccagcacaaaacgtcggccaatcagctgctgcccgcgctggtttaaatgactatcgctgtgcttttgttcgcgcacccgccgcgacaaccatttccaccacagccaggcggcgagcagcgtcaggatggcaaacattaccccttgccactcccaacccagcggcaccagccagaccaccaggccggtaatcaccgctgccacgccgctccacaacaaataaccatttccgcccagcatctcggctgccagcagcaaaccgccgagactgagccagaaaatatgtggatgaacgaccattaactccatcatggctgagtccgtttgttggcgctgtctttcaccagctcggcaatcccggcaatcgaccccatcaggctgctggcctctaatggcatcatcactactttgctgttactggaggaaccgatctgctgtaacgcttcggtgtatttctgcgctacgaagtagttcaccgcctgaatatcaccggaggcgatagcttcagacaccattttggtggcgcgggcttctgcttcggcggaacgttcacgcgcttcagcctgtaaaaacgccgactgacgttcgccttccgctttcaggatttgcgactgtttttcaccttcggctttgaggatttccgcctgacggatcccttccgcttcaagaatgtaagcgcgtttggtacgttccgctttcatctgcgcgttcattgaagagataagctctgccggtgggcgcacgtcgcgaatttcaatacgggtgactttaatcccccacgggttggtggcttcatcgacaatacgcagcaggcgtgagttgatgctgtcgcgctgagagagcatttcgtcaagttccattgaacccagcacggtacggatgttagtcatggtcaggttgatgatcgccagctccagattgctgacttcataagccgcgcgcggcgcgtcaatcacctgaataaagcacacggcgtcgatggtaacgttggcgttatctttcgagataacttcctgggaagggatatcgagcacttgctccatcatattgatcttgcgaccaatgcgatccataaacggcaccaccagactgagccccggctgtaacgttttggtatagcgaccaaagcgttctactgtccactgatagccctgcggtacgattttgacacccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatgcgaagattcttaataacatcaatttttcgctgcgtgctggcgaatttaagttaattaccggtccttctggttgtggcaaaagtacgctgctaaaaatagttgcttcattgatcagcccaaccagcggaacgttactgtttgaaggtgaggatgtcagcacactaaagccagaaatctaccgccaacaagtctcttactgcgcccagacaccgacgctgtttggcgatacggtatacgataatctgatctttccctggcagatccgtaaccggcagcctgacccagccatttttctcgattttctcgaacgcttcgccttgccggacagcattttgacgaagaatatcgccgagctatctggtggtgaaaaacaacgcatctcattgattcgtaacctgcaatttatgccgaaggttttattgctggatgaaataaccagtgcgctggatgaaagtaataaacataacgtcaatgagatgatccatcgttatgtgcgcgagcaaaatattgccgtgctgtgggtgacacacgataaagacgaaattaatcatgcggataaagtgattacactgcaaccgcatgccggagaaatgcaggaagcacgctatgaactcgcataatattactaacgaatcattagcactggcattaatgctggtggtggtggcaatcttaattagccataaagaaaaactggcgctggagaaagatattctctggagcgtcgggcgagcgataattcagctgattattgtcggctatgtgctgaagtatattttcagcgtggatgatgccagcctgacattattgatggtgttatttatctgctttaatgcggcgtggaacgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgattgccggtaacgccatggtagcggtggggttgtgttacaacaatttagggcaacgggtcattagcgaacagcaacagattcaggagaaactgagtcttggtgcgacgccgaagcaggcttcagcgatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaaccgccagcttgtcgaccattattgcctgctatttaacctatcgtaagttttataattcgcgccaccagttggtggtgacgcaattgaagaagaaatgatgcgatgccggatgcgcagcatcgcatccggcgttgtggttcatgtgccgatcaacggaatatcaatacaacaatgcatacagctggcggcgatacttcgacgccagtgcatcacccgtacccagcgcagcgaggatctcctggaacgttttacgcgtctgaccgtctgcggcggtgagatctttacgcagatgcccgaacagcaactccagcgcctcttcattgcgcccaacctgatgcagttgcagcgccagttgcgtcgccagtgcggcatcttctggattctccgccacctgctgttgcaactgttgaatttccggcgtatcagccgcctgcttcagcagttcgatttgcgccaccagcccctggtagcgggtgtcctgatcctgcaacggaatggttttcagcaccgcttccgcatcttcagaacggttcagcgcaatcagcgtttctgccagcagcaggccgatctccccgttctgattcgacaactgccaggcgtctttcagcaatggcagggcatcggtgtaattgctttcctgcatcagttgcatcgcctgctgcgctttcagctcttcttcgcgcggcagcactttatccagcagggcgcggatcgcctcttccggttgcggcccctggaagccatctaccggttgcccgttctggaacagatacacggtcggaatcgcacgcagaccaaactgcgcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattaccgcccaggtcaccagcgtcaccggatagcgcatcttcggcttctcgctaataaaagcatggcgtactttgtccaccaccgcttccggtcccaacgtaaagcgggcggcgatgccgggattttcgactggtttatcactttgcgtctggttgacgttgtcggtgaagcgagtacgaatgggaccgggttcgatcaggctgactttaattccgctgtggcgcagctccatgcgcagtgcatctgaccacgcctccagcgcatatttactggccgcgtaagcgccacgacccggcgtggagattaatcccatcaccgatgatgtcatcacaatacgcccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacctcgtcggctgcgcgatcaacactttctggtgaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggcttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaaaatctggcgcagcgtttgctcggtttgctgtggctgaaaaccacgcaaaccgtcattgccgcccagttcaaccagcacccaacgcggctgatgctgtttcagcagagccggaaggcgcgccagtccttgttgcgaggtgtcgccgctgatgctggcattaactaccgacgttttactctgccacttatcattcaacaaggcaggccaggccgcgctggcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggcttgatgacggcagcagtggcgaagtgagtctggtgggacaaccgctacataatatggacgaagaagcgcgggcaaagttgcgcgcgaagcacgtcggctttgtttttcagtcatttatgttaattcctacccttaacgcgctggaaaacgtcgagcttccggctctgctgcgcggtgagagtagcgcggaaagtcgtaacggggcgaaagcgttgctcgaacagttagggctgggtaaacgtctggatcatcttccggcacagctttccggcggtgaacagcaacgagtggcgctggcacgagcctttaatggtcgacctgatgtgctgtttgccgacgaacccaccggcaaccttgaccgccagacgggcgataaaattgccgacctgctgttttccctcaaccgtgaacatggcaccacgttgattatggtgacccacgacctgcaactggcggcacgctgcgaccgctgcttacggctggtgaacgggcagttgcaggaggaagcatgattgcacgttggttctggcgcgaatggcgttcgccgtcgctattaattgtctggctggcgctaagcctggcggtggcctgcgtgctggcgctgggcaatatcagcgatcgcatggagaagggcttaagccagcaaagccgtgagtttatggcgggcgatcgggcgttgcgcagttcacgcgaagtgccgcaagcgtggctggaggaagcgcaaaagcgcggcctgaaagtcggcaagcagctgactttcgccacaatgacctttgcaggcgacacaccgcagctggcgaacgtcaaagcggtggatgatatctacccgatgtatggcgatctgcaaactaatccccctggcctgaaaccgcaggcgggcagcgtattgctggccccacgcctgatggcactgcttaacctgaaaacgggcgacaccattgacgtgggcgatgccaccttgcggattgccggagaagtgattcaggaaccggattccggttttaaccccttccagatggctccgcgtctgatgatgaatctggcggatgtcgataaaaccggagccgtgcagccggggagtcgggtcacctggcgttataaattcggcggcaacgagaaccagctcgacggctatgagaaatggttgttacctcagcttaaacccgaacaacgctggtacggtctggaacaggacgaaggcgcgctggggcgatcgatggaacgctcgcaacagttcctgctgctttcggcgcttctgaccttgctgctggcagtggcagcggtggcggtagcgatgaatcattactgtcgcagtcgctacgatctggtggcgatcctcaaaacgctgggggcagggcgagcgcaactgcgtaagctaatcgtcggtcagtggttgatggtgctgacgctttcagccgttaccggtggggccataggcctgttgttcgaaaacgtgttgatggtgctgctcaagcccgttctgcctgctgcactaccgccagccagcctctggccgtggctgtgggcgcttggcaccatgacggtcatctcgctgctggtggggctacgaccatatcgcttgttgctggcaacgcagcctttacgcgtattacgtaatgatgtggtagcgaacgtctggccgctgaagttttatctgccgattgtcagtgtggtggttgtgctgctgctcgccggattaatgggtggcagcatgctgctttgggcggtgctggcgggcgcggtagtactggctttgctgtgcggtgtgctgggctggatgctgctgaatgtacttcgccgcatgacgctgaaatcgctgcctctgcgcctggcggttagccgcctgttacgtcagccgtggtcaacgttaagtcagctttcggcattttcgctctcctttatgctgctggcactgctgctggtgttgcgtggcgatctgctcgaccgctggcagcagcagctacctccagaaagcccgaactactttttaattaacatcgccacagaacaggtagcaccgctaaaagcgttcctcgcggaacatcagatagtcccggaatcgttttatccggtggtgcgggcgcggctgacggcgattaacgataagccgacagaaggtaatgaagatgaggcgcttaaccgcgaactcaatcttacctggcaaaatacgcggcccgatcataatccgattgtcgccggtaactggccgccaaaagccgatgaagtgtcgatggaagaggggctggcgaaacgcttaaacgttgccctcggtgataccgtgacttttatgggcgatacccaggagttccgcgctaaagtgaccagcctgcgcaaagtggactgggaaagtctgcggcctaatttctattttattttccctgaaggggcattagacgggcaaccgcagagctggcttaccagtttccgctgggagaatggcaacggcatgttgacacaactcaaccgccagttcccgaccattagcctgttagatattggcgcgattttaaaacaggtcggtcaggtgctggagcaggtaagtcgggcgctggaagtgatggtggtactggtcaccgcctgcggtatgttgctgttgctggcacaggtgcaggtgggaatgcgtcagcgtcatcaggagctggtggtgtggcgcacactcggtgcggggaaaaaactgctgcgtaccacgttgtggtgtgagttcgccatgcttgggtttgtttccggcctggtggccgcaattggtgcggaaacggcgctggcagtgttgcaggcgaaagtgtttgattttccgtgggagccagactggcgattgtggattgttctgccgtgcagcggagcgctgctgctgtcgcttttcggcggctggctgggtgcgcgactggttaagggtaaggcgctgttcaggcagtttgcggggtgatgagagtaaataaggggcgttctggttgaatggaacgccttgtttaaattaattctacaatatgtttcattgatgatgttattgaattggtgatttcctatctttctattgctgatattaatctgaatcggtggagtttattgattttaaatatagccctacaaaaataactcagactaataaaatcataaatcatatgcgttgaatggatattatccatatagtgaatttgttgatgatgaattcatctgtgctaaaaatgttagtttaataaaatattgaaagtgacctgtaataacagttgttgttgattgagaacaaataagtttatgtgaaaaatatataaatacattagctggtcttgtgtgtcattttatttttttttgttgctaacacagggatatgaacaataactaaaagggcactttatatgagcggaaaaccagcggcgcgtcagggagatatgactcagtatggcggtcccattgtccagggttcggcaggtgtaagaattggcgcgcccaccggcgtggcgtgctcggtgtgtccgggcgggatgacttcgggcaacccggtaaatccgctgctgggggcgaaggtgctgcccggcgagacggaccttgcgctgcccggcccgctgccgttcattctctcccgcacctacagcagctaccggacgaagacgcctgcaccggtgggcgttttcggccccggctggaaagcgccttctgatatccgcttacagctacgtgatgacggactgatactcaacgacaacggcgggcggagcattcactttgagccgctgctgccgggggaggcggtgtacagccgcagtgagtcaatgtggctggtgcgcggtggtaaggcagcacagccggacggccatacgctggcgcggctgtggggggcgctgccgccggatatccggttaagcccgcatctttacctggcgaccaacagcgcacaggggccgtggtggatactggggtggtctgagcgggtgccgggtgctgaggacgtactgccagcgccgctgccgccgtaccgggtgcttaccgggatggcggaccgcttcgggcggacgctgacgtaccggcgtgaggccgccggtgacctggccggggaaatcaccggcgtgacggacggtgccgggcgggagttccgtctggtgctgaccacgcaggcgcagcgtgcggaagaggcccgcacctcttcgctatcttcttctgacagttcccgccctctctcagcctcagcgttccccgacacactgcccggtaccgaatacggccccgacaggggtatccgcctttcggcggtgtggctgatgcacgacccggcatacccggagagcctgcccgctgcgccactggtgcggtacacgtatacggaagccggtgaactgctggcggtatatgaccgcagcaatacgcaggtgcgcgctttcacgtatgacgcgcagcacccgggccggatggtggcgcaccgttacgcgggaaggccggagatgcgctaccgctacgacgatacggggcgggtggtggagcaactgaacccggcagggttaagctaccgctatctttatgagcaggaccgcatcaccgtcaccgacagcctgaaccggcgtgaggtgctgcatacagaaggcggggccgggctgaaacgggtggtgaaaaaagaactggcggacggcagcgtcacgcgcagcgggtatgacgcggcaggaaggctcacggcgcagacggacgcggcgggacggaggacagagtacggtctgaatgtggtgtccggcgatatcacggacatcaccacaccggacgggcgggagacgaaattttactataacgacgggaaccagctgacggcggtggtgtccccggacgggctggagagccgccgggaatatgatgaaccgggcaggctggtatcggagacatcgcgcagcggggagacagtacgctaccgctacgatgacgcgcacagtgagttaccggcgacgacaacggatgcgacgggcagcacccggcagatgacctggagccgctacgggcagttgctggcgttcaccgactgctcgggctaccagacccgttatgaatacgaccgcttcggccagatgacggcggtccaccgcgaggaaggcatcagcctttaccgccgctatgacaaccgtggccggttaacctcggtgaaagacgcacagggccgtgaaacgcggtatgaatacaacgccgcaggcgacctgactgccgttatcaccccggacggcaaccggagcgagacacagtacgatgcgtggggaaaggcggtcagcaccacgcagggcgggctgacgcgcagtatggagtacgatgctgccggacgtgtcatcagcctgaccaacgagaacggcagccacagcgtcttcagttacgatgcgctggaccggctggtacagcagggcggctttgacgggcggacgcaacgttatcattatgacctgaccggaaaactcacacagagtgaggatgagggacttgtcatcctctggtactacgatgaatcggaccgtatcactcaccgcacggtgaacggcgaaccggcagagcagtggcagtatgatggccacggctggctgacagacatcagccacctgagcgaaggccaccgtgttgccgtccactatggctatgacgataaaggccgcctgaccggcgaatgccagacggtggagaacccggagacgggggaactgctgtggcagcatgagacgaaacacgcatacaacgagcaggggctggcaaaccgcgtcacgccggacagcctgccgccggtggagtggctgacgtatggcagcggttacctggcgggaatgaagctgggcgggacgccgctggtcgagtatacgcgggacaggctgcaccgtgagacggtgcgcagcttcggcagcatggcaggcagtaatgccgcatacgaactgaccagcacatacacccccgcaggccagttacagagccagcacctgaacagcctggtatatgaccgtgactacgggtggagtgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagctcatctttatcactgcgaccaccggggactgccgctggcgcttatcagcgaagacggcaatacggcgtggagcgcggaatatgatgaatggggcaaccagcttaatgaggagaacccgcatcatgtgtatcagccgtaccgtctgccagggcagcagcatgatgaggaatcagggctgtactataaccgtcaccggtactacgatccgttgcaggggcggtatattactcaggacccgatggggttgaaagggggatggaatttatatcagtatcctttaaatccactacaacaaattgaccctatgggattattgcagacttgggatgatgccagatctggagcatgtacggggggagtttgtggtgttctttcacgtataataggaccaagtaaatttgatagtactgcagatgctgcgttagatgctttgaaagaaacgcagaatagatctctatgtaatgatatggaatactctggtattgtctgtaaagatactaatggaaaatattttgcatctaaggcagaaactgataatttaagaaaggagtcatatcctctgaaaagaaaatgtcccacaggtacagatagagttgctgcttatcatactcacggtgcagatagtcatggcgattatgttgatgaatttttttcaagtagcgataaaaatcttgtaagaagtaaagataataatcttgaagcattttatctcgcaacacctgatggacgatttgaggcgcttaataataaaggagaatatatttttatcagaaatagtgtcccgggattgagttcagtatgcataccgtatcatgattaattttagtgcttttattagtggggcctataaggagattcaatgaaatatagttcaatattttcgatgctttcattttttatactatttgcctgtaatgagacagctgtttacggttctgatgaaaacattatttttatgaggtatgtggaaaaattacatttagataaatactctgttaaaaatacggtaaaaactgaaacaatggcgatacaattagctgaaatatatgttaggtatcgctatggcgaacggattgcagaagaagaaaaaccatatttaattacggaactaccagatagttgggttgttgagggagcaaagttaccttatgaagttgcgggtggtgtatttattatagaaattaataagaaaaatggatgtgttttgaatttcctacatagtaaataatgctggcgctgatggatgcggatggaaacattgcgtggagcggggagtatgatgagtggggcaaccagctgaatgaagagaacccgcatcacctgcaccagccgtaccggctgccggggcagcagtatgataaggagtcggggctgtactacaaccggaaccggtactacgatccgttgcaggggcggtatatcactcaggacccgatagggctggaggggggatggagtctgtatgcgtatccgctgaatccggtgaatggtattgatccattagggttaagtcccgcagatgtagcgctaataagaagaaaagatcaactaaaccatcaaagagcatgggatatattatctgatacttatgaagatatgaagagattaaatttaggtgggactgatcaatttttccattgtatggcattttgtcgagtgtctaaattaaatgacgctggtgttagccgatcggcgaaagggctgggttatgaaaaagagattagagattacgggttaaatctgttcggtatgtacggcagaaaagtaaagctatcccattctgaaatgattgaagataataaaaaagacttggctgtaaatgaccatgggttgacatgtccatcaacaacagattgctcagatagatgtagtgattatattaatccagagcataaaaaaacgataaaggctttacaagatgctggctatctcaagtaatctatcaaagatgataatatttatttttgctattataatcattgttgttttatgcgtaattacttatctttatttatacaaagatgaatctcttgtaagtaaacattacataaactatatggcaataccagaaaatgatggagtttttacatggctcccagatttttttccgcacgtagcggtggatatatcaatatacacaaatgtagaagatgattatttttttcttatttttccctaacaaatgatgatgggggtaggtttaagaaaacattgacagtgagggccagggaacaagtggcgaaaatcgtatcaaagaatgatccagatacaaaaaaagtgtggtgtaaatatggtaagataccagggcaaggggatggtgtaaaccttttttttgttggtgaaattaatgttacgcattattttataacaaatattggagctggattgcctgatgcttgtgcagagtaattgcttgaattaagagtctatcccatatcgaagtcgtcaacttcgtagtgaggaaaagtaaaattcctgactgagaaaagacatgtcggctattgtgtaaagccatatagctcagacgatgaatatctactcgtattcagttgtttattgagggtgagttccgaccctgaaacaacaaataaaatgaacagtcagagagtttacatagaattgcactggtcttttacgatatctgacattgtgtaatacatattcagccatgcattaattaaaatgttacgtgtttaatgtgagtccctatctgaaaataaataatccttccggattaaaataaattcttgccgggaaagaaagaggaaataaaccattagcggaaaaccagcggcacgccagggtgacatgccccagtacggcggcccgatagtccagggttcagcgggggtactgatagtcgcgccgactgcatcgagaactccatacaactttttacggaacgtcacctgataaaatttgttcagtatcgtcttttgagattctcaaggttatggagtaaccagacagaacggacaccactgtcggagataaaaaccccctgtttacgcagctcgttgctggcccggtgctgaccatgtgtcgggaaagcgacggcgtaatcaacaacagcctgttcagttgcctcatcggtacggttcttaaggttaggagcgcggcgactacgattaatctgcgcatccacaccgccttcagcgaccagttcgcggtaacgataaaacgtatcacgcgaaacgcccatgattttacaggcttttgatacgttgctgagttcttcagccagattgagcaaaccggctttgtgtttgatgacgggattggcagtatgaagcatgagagttacctcttgttttggataaggattcgacactcatatcaaaaccggtaactctcaacctttcaaggccatgtgtcagatcaagtcgcgactaatacaaatacgtccctcattaccgcgccttaacccattccgccacttccgcccactcaccgcgaaagacaactttttccgcttttttctcaagctgatagcgatacatcgggtcgtaatattcttcaagtaacggcaccagccaggccagatgaccgtcggtgctgccggtggtgagttgcgttgtcagtgctgcatccagccttgcagccagttcgttatagcgctgtagccccagccgacgcttaatcgccgaaagtccgtgatgcaggtattcgcaatactcctgccagccctgttcgtcgccgtacgcgtgggtaaaatcatgatgcatacgcaagaaatactcttcgttcaggcgctcaagacggatctcaaacggatcttctaccaccgcaatcgccgcctgagtcattcgctcgcgcaggcattccggcaggtgattcgaaccgatcatccggctttcgtcttccagcacccacaggcgcaaattctgacgggcgtcggtttttagcatttcggcagccagcaggttttcaaaactcgcctggctaagttgtggttgtaacgtgcgaccaaacgccgaaccgcgatgacgcgccaacccttccagatcaacaccgttcggctgttgctgcactaacagcgttttaccgctgccggtacaaccgccaatcagcactatcggtttttgtgccagttcaatagtcgcctgaatcgcggtctggcgcagtgccttataaccgccttccaccagcggataatcaatccccgctgcatgcaaccagctttgcacaatatgtgagcgctgaccgccacgggcgcagcagagaataccttgcggattttgcaggcacgctgcccgccaggcgtccatgcgctgctgacgaatttcacccgccaccagtttatgtcccagcgccagcgctgcgtctgagccttgctgtttatagcaggtgccaacggcggcgcgttcatcgttattcattaacggcagattgatagcggcgggcattgcgccgtgctcaaactcgataggggcgcgaacatcaataatgggcgtatcagcaatcagcagggcacgatagtcctgttccgtgtgtctctcttgcatagttaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgatcattgactggcaaagcgattttggcaaaaaaccaatgccaacgcccgccagatgggcggcgattttcgtttccatatcgggaacaataatctctttttgccctggcaatcgccaggcgacgcgtttggttaaggtgcgggcgctgtcttcaatattgaccgccggaaagcgccgcaactgcgcttctgttagcggctcttcaacgttcgccagcggatgatccgccgccatgacaaagcgccattgcaccgatcctaagggatcaagactaaaggtatttgccagcgcctcagttcccgtgacgccgatagccagcgaaaaaccttcgtacaatagcgagtcccagacgcccatatagatttgtcgggagatgtgaaactgggtaaaggggtaacgctcattcagccacgccagcaactgggcgacggcctgggggttgtagagcaggttgttgatgacaatattcacctggcgttccacgccatcattcacctgttgcagctcgcttggcatactttccagccagctcagccagtctctggcctgggaaagtagatgctcgccagccgctgtcaacgtcacgctgcgagtcgtacggaaaaacagcgctactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatctagttttggaaaaatattccaacttttgtattgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagcaacgggattttttccatattaacaatggcctggtggagcgttaccacgatttggcgctggttgagattcttgagcaagactgtacgcttatcagcattaaccgcgcgcaaccggcgaatctgccgctgaccattcacgaactcgaacgtcatccgctgggtactcaggcctttatcccgatgaaaggtgaggtgtttgtggtggtcgtggcgttaggtgacgacaaaccagacctgtcaacgctgcgggcgtttatcaccaacggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaactaattgttcattgtttatgctcacttgtaggtcggagttaacgtaggtatgacggaagttagacggcgcggcaggccaggacaggcggagcctgtggcacagaagggcgcacaggcgttagagcggggaattgcgattctgcaatatttggaaaaaagtgggggaagttcgtcggttagcgatatttctctcaatctggatttgccgctctccacgacctttcgcttgctgaaggttttacaggcagcggattttgtctatcaggacagtcaattaggctggtggcatataggattaggtgtctttaacgtcggtgcggcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcaggatgtgtgcgccactgggcagtcgtctgccactgcatgcttccggtgcgggcaaagcgctgctttatccgctggcggaagaggagttgatgagcatcattctgcaaaccggtttgcagcagtttacgccaactacgcttgtggatatgcccaccttgctgaaggacctggaacaagcgcgtgaactgggctataccgtagataaagaagagcatgttgtaggtctgaattgcatagcttcagcaatttacgatgatgtcggtagtgttgttgccgctatctccatctccgggccttcatcaagactgacagaagatcgttttgtcagtcagggtgagctggtcagagacaccgcccgcgatatcagcacggcgttgggactgaaagcacatccataatgtctgtcgcatcccgctctgcggagcgggtttttttgacaaaatttgaaagttggaaaaattttccaataaatagaggtaggaataaaatggcaaaaatgagagccgttgacgcggcaatgtatgtgctggagaaagaaggtatcactaccgccttcggtgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcttctgctgattccattcctattctgtgcattaccggccaggcaccgcgcgcccgtctgcataaagaagattttcaggccgtagatattgaagcaattgctaaaccggtcagcaaaatggcggttacagttcgtgaagcggcgctggtgcctcgcgtgctgcaacaggcatttcacctgatgcgttctggtcgtccgggtccggtactggtggatttaccgttcgacgttcaggttgcggaaatcgagtttgatcctgacatgtacgaaccgctgccggtctacaaacctgctgccagccgtatgcagatcgaaaaagctgtagaaatgttaatccaggccgaacgtccggtgattgttgccgggggcggggtaattaatgctgacgcagctgcactgttacaacagtttgctgaactgaccagcgttccggtgatcccaacgctaatgggctggggctgtatcccggacgatcatgaactgatggccgggatggtgggtctgcaaaccgcgcatcgttacggtaacgcaacgctgctggcgtctgacatggtgtttggtatcggtaaccgttttgctaaccgtcataccggctcggtagagaaatacaccgaagggcgcaaaatcgttcatattgatattgagccgacgcaaattggtcgcgtgctgtgtccggatctcggtattgtctctgatgctaaagcggcgctgacactgctggttgaagtggcgcaggagatgcaaaaagcgggtcgtctgccgtgtcgtaaagaatgggtcgccgactgccagcagcgtaaacgcactttgctgcgcaaaacccacttcgacaacgtgccggtgaaaccgcagcgcgtgtatgaagagatgaacaaagcctttggtcgcgatgtttgttatgtcaccaccattggtctgtcacaaatcgctgcggcacaaatgctgcatgtctttaaagaccgccactggatcaactgtggtcaggctggtccgttaggctggacgattccggctgcgctaggggtttgtgccgctgatccgaaacgcaatgtggtggcgatttctggcgactttgacttccagttcctgattgaagagttagctgttggcgcgcagttcaacattccgtacatccatgtgctggtcaacaacgcttatctggggctgattcgtcagtcacaacgcgcttttgacatggactactgcgtgcaactcgctttcgagaatatcaactccagtgaagtgaatggctacggtgttgaccacgtaaaagtagcggaaggtttaggttgtaaagctattcgggtcttcaaaccggaagatattgcgccagcctttgaacaggcgaaagccttaatggcgcaatatcgggtaccggtagtcgtggaagttattctcgagcgtgtgaccaatatttcgatgggcagcgaactggataacgtcatggaatttgaagatatcgccgataacgcagcggacgcaccgactgaaacctgcttcatgcactatgaataagggagataaataatgttacgtttctctgctaatttatcgatgttatttggagaatatgattttctcgcccgttttgagaaagctgcgcagtgtggttttcgcggcgttgaatttatgtttccttatgactacgacattgaagaattaaaacatgtgctggcgagtaataaactcgaacatacgctgcacaatttaccggcgggtgactgggcggcgggggagcgcggtattgcctgtattcctggccgtgaagaagagtttcgggatggcgtagcagcagcgattcgttatgcccgtgcgctgggtaataaaaaaattaactgtctggtcggtaaaacgccggctggtttcagcagtgaacagattcacgcaacgcttgtagaaaacctgcgttatgccgcgaatatgctgatgaaagaagatattttattactgattgaacctattaaccattttgatattcctggtttccatctcaccggaactcggcaggcgctgaaattgattgatgatgttggttgctgcaatttgaaaattcagtatgacatttatcatatgcagcggatggaaggtgaattaaccaacaccatgactcagtgggctgataaaattggtcacctgcaaattgccgataatccgcatcgcggcgaaccgggaaccggagaaattaattatgattatctctttaaggtaatcgaaaattctgactacaacggttgggttgggtgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaattacatgtcacgaccattggaccggttgctgatgaattactgtcactgggtgccgtcagtgttgaaactgctcgccaggtaacggaagcatcggacatcatttttattatggtgccggacacacctcaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgatggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcatggcgagcgtatgattaaacgcacctttaatccgggcttcaaaatcgctctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtgatggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtataccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaattaatcccgatattgaacattgagttaaaaaccaatctgtattttacaaggagtttgttatgtcttttgatttaatcattaaaaacggcaccgttattttagaaaacgaagctcgcgttgtagatatcgccgttaaaggcggaaaaattgctgctatcggtcaggatctgggcgatgcaaaagaagttatggatgcgtctggtctggtggtttcgccgggcatggttgatgcgcacacccatatttctgaaccgggtcgtagccactgggaaggttatgaaaccggtactcgcgcagcggcaaaaggtggtatcaccaccatgatcgaaatgccgctcaaccagctgcctgcaacggttgaccgcgcttcaattgaactgaagttcgatgccgctaaaggcaagctgactattgatgcggcacaactcggtggcctggtgtcttacaacatcgaccgtctgcatgagctggatgaagtgggcgttgtcggcttcaaatgcttcgttgcgacctgtggcgatcgcggtatcgacaacgacttccgtgatgtaaacgactggcagttcttcaaaggtgcgcagaagctgggcgaactgggtcagccggtgctggtgcactgcgaaaacgcgctgatttgtgacgaactgggcgaagaagcgaagcgtgaaggtcgcgtaaccgctcatgactatgtggcttcgcgtccggtatttaccgaagtggaagcaattcgccgcgtactgtatctggcgaaagttgctggttgccgtctgcacgtttgccacgtcagcagcccggaaggtgttgaggaagtgactcgtgcacgtcaggaaggtcaggacgttacttgtgaatcctgcccgcattactttgtactggataccgatcagttcgaagaaatcggtactctggcgaagtgttcaccgccgatccgcgatctggaaaaccagaaaggcatgtgggaaaaactgtttaacggtgaaatcgactgcctggtttccgaccactctccatgcccgccggaaatgaaagccggtaacatcatgaaagcatggggcggtatcgccggtctgcaaagctgcatggacgtgatgttcgatgaagcggtacagaaacgcggtatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtaccattggcgcgcgtatcacgaaaaccatcttacgtggtgatgtgatttacgacattgaacagggcttccctgttgcgccgaaaggtcaatttatccttaaacatcagcagtaatctggcccctgcaatgcccgtccttgcggcgggcattctccggttaaggtgtgtttatgttcaattttgcagtcagccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttttgcggtcatcgtcgcgctattatggaagggccaggtggcctgtggtggggaaccatccttactatcacccttggtgaagcatcgcgcgggacaccgatcaacgatatcgccaccagcctggcagtggggattgcactctccggcgtgctgacgatgttgattggttttagcggattaggccatcgcctggcacggttatttacgccgtcggtgatggtcttgtttatgttgatgctgggcgcgcagctgaccactatctttttcaaaggtatgctcgggctgccgtttggcatagccgacccgaattttaaaattcagttaccgccgttcgcgctctcggtggcggtgatgtgcctggtactggcgatgattatcttcctgccgcaacgttttgcccgttatggcctgctggtcggcaccataaccggctggttgttgtggtacttttgctttccttcttcgcactcgctctccggtgagttgcactggcagtggttcccgctcggcagtggcggtgctttgtcgccgggaattattctgacggcggtgattacaggtctggtaaatatcagcaatacctacggtgcgattcggggcacggatgttttttatccgcagcagggcgcagggaatacgcgttatcgtcgtagctttgtggcgaccggatttatgacgctgataaccgtaccgctggcggtaattccattttcaccgtttgtttcatccattggtttattaacccagactggcgattacacgcggcgttcgtttatttatggcagcgttatttgcctgctggtggcgctggttcctgcactcacgcgactgttttgcagtatccctttacccgtgagtagtgcggtcatgctggtttcttatctgcctttactcttttccgcgctggtgtttagccagcaaataacgtttaccgctcgcaatatttatcgactcgcattgccgttatttgtcggcatatttttaatggcattaccgcctgtgtatctgcaagaccttccattaacgcttcgtcctctgctcagtaacggcttattggtcgggattttactggctgttcttatggataaccttattccgtgggaacgcatcgaataatttgttgaaaaaggattgataatgaagattgtcattgcgccagactcttttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacgacattcgccatattattctcggcattggcggcagtgcgacggtcgacggcggtatgggcatggcgcaggcgctcggtgtgcgtttccttgatgccgacggtcaggcgctggcggcaaacggtggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggagatggtcgaagaacttgaacaggggctgcaaaattacgcccgtgttttacaacagcaaactgaaattaatgtctgccagatggcgggcggcggcgctgcgggcggtatgggtattgcggcggcggtatttctcaatgcggatattaaaccgggcattgaaattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtacggcattgacgcggtattcagcattttgcctcgtctggcacctttagccgaagtgctcgccagcggtgaaaccaatctcttcaacagcgcgcgaaatattgcctgcgccattaaaataggtcagggaattaaaaactaacccttacctttaaagcggatgcgatttatatcgcataagagtgcagtactcatgccggatgcggcatgagtaccatatccttcctgaaaatcgcgcaaattctatatattgcagagatcatgtaggcctgataagcgaagcgcatcaggcaatgttacaaaaaaagccacggtataaaccgtggcaaaatccaacatagctaaaaataatcaggcgagtggtatgacttaaatctctacgtcgcggttacaatctttcgagtaaatatagctgaacgcttcaccacgccctacaccataaccagcctgtaaagaataagcgcccataaagatgtaatcgccttttttcaccgggatccagttattgtcgaggttataaaccccctgaccggaaagaatataggcaccgtgttcctgaacgtgtgtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggtgcatagccttctaccggaacatagcggcgcttatataaaaagatttggctgtcttcggcctgggcgttaacaaacgtcattaaggagcctggcgggcaataaagatagccaccttcgcttaaggcaaatgttttgccttcggctttggcagtgatatttccagagatcacatacaggaacgtttcaatgccttcgccaccgaagccctgttggttgccaccgttttgatgcagtgtgaccagataatcaacaaaagaggcacccagctttggcgtggagaggattgtcgcgtcacaattttcaaagcccggaataatattttttaccagaccatccggggttaacagtgcgaaattaccgtgtttaacaatcgcacggttagccagtaaatcttcgcggtaaccggtgacgttatttaaatatcccatttatgactccttatttctgccaggcaagttgataaagcatgagtgccaacgttttgaccccttcggcaaggtcggtaatattggtgcgttccgccgggttatggctgatcccgttgatgctggggataaaaatcatgcaggttggtacgcgaggcgcgaaaatttgcgcgtcgtgcccggcaccactgtgcatcacccggtaattcagtttttctctttcacacaattctgtcagggtggcgaccagctccttattcatcggcacgggttcttcgtccatccataaatcgatatcaataccaatgtccatttcatcgcaaatcgcccgcatgtcgttttctaactgttgggtgaaatcgcgcagcacggcagcgtcggtatgacgacaatcaatggtgaacgtggttttacccggcaccacatttaccgtattcgggcgcggctctactttgccaaaggtcagaaccagcggatcgcccatccttttcgctttttcgaccgactgatggcaaatgcgactgaaagcgtaaactgtatcacgacgataacccatcggcgtggtgcctgcatggtttgattcgccgttcagcgttaccgtataacgacgctgcccgacaattgcattcaccacgccaattgattgcccattactttccagcacacagccctgttcaatatgcagttcaacaaaggctttaatatcctgacgcggagttagtggggcgttcggaagagtaaatccgcaagccttcatcgcatcgacaaaactatttcctttggcatcacagatattccgcacgtcgtcaggattcgccagcccaaaaatatttttactgccccagaagacatacgggaagcggctgccttcttcttctgccatcgccaccacttcgaccgtacgtagcggcgcgccgtattgcgttttcagccagtcaattgccagccacgccgccagcgcgccgaattgcccgtcaaggttaccgccgttaaccacggtatcgatatgcgaaccgctcagaaccacttcctgtggatattcggtgccattcaggcgaccgtataaattccccacttcatcgaaacgtgtttccagcccgcttgctgccattctttttttaaattgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggctttgcgttgtttaatatcctgatcctgtccgggataataaacctgattaaaaccgggcgcgggggtaatggcatttaattcgcgcatggtctggctaagatgttgacggaataattcgctggaggagaaaaagttcggattaataactatatgtaattgccccaaattacgccctgcgtgtaaatcgtcatacatcgaactaacctgtcgcccgaacggtaagccgagtaagacgcctgagaggacgtcaatcatcatcatcaggccatacccttttggcccggcggcggggagcagagcatgtaccgcgaacggatcggttgttggtacaccgtttttatcgaccgcccaggtatccgggatagacatattacgcgagcgggcgtcgagcacttttccccatgcctgtacggtagtcgccatatcaaaggtaaggatctcgtcgccttctcccggcgcggcaaaggccagggggttagtaccgtagtaaatttccgcgccgccaaacggcaccaccattggatcggactggcacatcgaaatgccaatgaatccggcgcgggctgcctgctgcacaaaataagagattgcgccgctgtgacccatccggctgataccgaccaccgcaacgccattttgctgggcggttttgatggcatgttccatacccattttcgccgcgacctgtccggcggcattgtcggcatgtaaaattgccgagcacggcccggtttcctcaagacgaaactccggttcgcggttggtgccgccttttgaaatgcgttccgcgtagtattccacgcgcaccgcgccatgagagtggatccctctggcatcggcgtaaaccaatacttcagccacggttgcagcgtgctcacgttttaacccagcctggcagagtttattctcaattagctggtggagtgtttcccgactgattttcatctgtcttcctttttaacgacggtgtgaagcatgactgcaattaacatacagggaaaatatctggattatgtgatccagacaggcaaaaaaatatagttagaatttatttgataatccgctcacttttaacctgatttttaaaacaacaacgcttattaaaaaataatgagtaatagcctggtggttatttgaattcttttgttaataattcctgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagataccacaggtttctggcatgacgattttaataacgccacgccgaacgatatttgcgtggcaattcgtagcgaagcggcggatgcggggatcgcgcaggcgattatgcagcagcttgaagaggcgctaaaacaactggcgcaggggtcaggcagcagccaggcgttgacgcaggtgcgtcgctgggacagtgcctgtcagaaattacccgatgccaatctggcgctgatttcagtggctggcgagtatgcggcggagctggcaaaccaggcgctggatcgcaacctcaacgtgatgatgttctccgataacgtcacgctggaagatgaaatccaacttaaaacccgcgcgcgggaaaaaggcttgctggtgatggggccggactgcggtacgtcgatgattgccggcacaccgctggcttttgctaacgtgatgccggaaggcaatattggcgtcattggcgcttccggtaccgggattcaggagctgtgttcgcagattgcgctggcaggggagggaattactcacgcgattggccttggcgggcgcgacctcagccgtgaagtgggcggcatcagtgcgctaacagcgctggaaatgctcagtgcagacgagaaaagcgaagtgctggcatttgtttcaaaaccacctgccgaagctgtgcgtctgaaaattgttaatgccatgaaagcaaccggcaaaccgacggtggcgctgtttttaggttataccccggcggtggcccgcgacgagaatgtctggtttgcctcctcgctggatgaggccgcacgcctggcttgcctgctttcacgcgtcacggcgcgacgtaacgcaatagcgcctgtcagcagcggatttatttgcggtttgtataccggcggtacgctggctgccgaagcggcgggattacttgccggacaccttggcgtggaagccgacgatacccatcaacatggcatgatgctggacgccgatagccaccagattattgacctcggcgatgatttctacaccgtcgggcgtccccatccgatgatcgacccaaccttacgcaaccagttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgtttagataatcaaccactgtatgccattgccacggtgacaggcactgaacgtgacccgcaatgccgctcgcagcaaatcgccacgctggaagatgcggggattgcggtcgtgagttcgctaccggaagccaccttgctggcggcagcgttaattcatccgctctcgcctgccgcacagcaacacacaccgtcattactggaaaacgtcgccgtgattaacatcggattacgcagctttgcgctggagctacaaagcgccagcaaaccggttgtgcattaccaatggtcgccagtcgccggtggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacgaaggcaaaacactgcttcacgccgggccgccaatgcgctggcaggagatgaccggacccatgaaaggggcgtgcgtgggcgcatgtctgttcgaaggttgggcgaaagatgaagcgcaggcgctggcaatactggagcaggggaagtgaacttcattccttgtcaccatgtgaatgccgtcgggccaatgggcggtattacttctgccagtatgccgatgctggtggttgagaacgtgaccgacggcaaccgggcgtactgcaacctcaacgaaggtatcggcaaagtgatgcgttttggcgcttacggcgaagatgtcctgactcgccatcgctggatgcgcgatgtgttaatgccagtattaagcgcggcgctggggcgcatggagcgcggtatcgatctcacggcgatgatggcgcagggcattacgatgggcgatgagttccatcaacgcaatattgcttcctctgcactgttaatgcgtgcgctggccccacaaattgctcgcctcgatcatgataaacagcacatcgccgaagtgatggatttcctcagcgtgaccgatcagttcttcctcaacctcgcgatggcttactgcaaggcggcgatggatgctggcgcgatgatccgcgcaggcagcatcgtcacggcaatgacccgcaacggcaatatgttcgggattcgggtaagcgggctgggcgaacgctggtttactgcgcctgtaaacactccgcaaggtctgtttttcaccggcttctcgcaggagcaggcgaacccggatatgggcgatagcgcgattaccgaaacctttggtatcggaggtgcggcaatgatcgcagcgcctggcgtaacgcgctttgtcggtgcgggtggcatggaagcggcaagagcggtatctgaagagatggcggaaatttaccttgaacgcaatatgcagttgcagatcccaagctgggattttcagggcgcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatgggtattggttgaggaacgcgcaatgacgatcatccatcctctgcttgccagtagtagcgcaccgaattatcgccagtcctggcggttagcgggagtgtggcggcgggcgattaacctgatgacggaaagcggcgaactgttaacgttgcatcgtcagggtagtggtttcggccccggaggatgggtgcttcgccgtgcgcaattcgatgcgttatgcggtggattatgcggcaatgaacgaccacaggttgtggctcaagggattcgcctcgggcgtttcacggttaaacagccacagcgttattgtttgctgcgtattacgccgcctgcgcatcctcaaccacttgcagctgcatggatgcaacgcgcggaggaaaccgggcttttcgggccactggcgttggcggcaagcgatccgctgcctgctgagttacgccagtttcgtcactgttttcaggccgcgctcaatggcgttaagaccgactggcggcactggctgggtaaaggccccggattaacgccgagtcatgatgacacgctgagcggaatgctgctggcggcctggtattatggcgctttagatgcgcgctccggtcgtccgttttttgcctgttccgacaatctgcaactcgttaccacagcggtgagcgtcagttatttacgttatgccgcgcaaggatatttcgcctcgccactcctgcactttgttcatgctctgagttgcccgaaacgtaccgctgttgcgattgattcgctgctggcgctggggcatacgtcaggggcagatacgctgctggggttctggcttggccaacaattattacaaggaaaaccatgaaaacactggttgtggctcttgggggcaacgccttactccagcgcggtgaggcgctgacggcagaaaatcaatatcgcaatatcgccagtgctgtacccgcgctggcacgcctggcccgttcttatcggttggcgattgttcacggcaacgggccgcaggtggggctgctggcattgcagaatctggcgtggaaagaggtagaaccgtatccgctggatgtgctggttgcggaaagccaggggatgattggctatatgctggcgcagagtttgagcgcacagccgcagatgccgcccgtgacgacggtgctgacgcgcattgaggtttcgcctgatgatccggcgtttttgcagccagagaaatttattggtccggtttatcagccagaagaacaagaggcactggaagcggcttacggctggcagatgaaacgtgatggtaaatatttgcgccgggtggtggcgtctccgcaaccgcgtaaaattctcgacagcgaagccatcgagttgttgctcaaagaggggcatgtggtgatttgcagtggcggcggcggtgtgcctgtgacggatgacggagcagggagtgaagcagtgattgataaagatctcgccgctgcgttgctcgccgagcagattaatgcagatggactggtgatcctcaccgatgctgatgcggtatatgaaaactggggaacgccgcagcaacgtgccattcgccatgccacaccggatgagttagcgccatttgccaaagccgatggttcgatggggccgaatgtaacggcggtgagtggttatgtcagaagccgtggtaaacccgcgtggattggggcgttatcgcgaattgaagagacgctggcgggcgaagcggggacctgtatttcgctgtagtcgtaggcattagacatttgtgcctgatgcgacgcttgacgcgtcttatcaggcctacaaccggtgccgcatccggcaattggtgcacaatgcctgatgcgatgcttgacgcatcttatcaggcctacaatgggtaccggatcggtaggccggataaggcgtttacgccgcatccggcaagaatagagcaccagttaaccgaacttactctgcgcccaaatcacgccgctggcatattccggcggcagcagcgggattaaggcttccagcgtcgcagtcagacgcgatgtgtcgctgtcggtcaaattcagatgccccactttacgccccggacggacttctttgtcgtaccagtgcagatgcaccagcggcagtttcagccagtcataattcacatcgctaccaatcagattgatcatcaccgacggattattcaccactggttgcggtaacggcagatcggtaatcgcccgcagatgcagctcaaactggctgatgctggcaccgttttgtgtccagtgaccgctgttatgcacacgcggtgccagttcgttgatcaacagaccttgcggggtgacaaaacactccatcgccatcacgcccacatagcccagctcctgcataatcgccgacagcatctcttcggcttgcgcctgctgctgtgcgttggcctgcggaaaagcgacgctggtgcgcaaaataccgtcctgatgcaggttatgcgtcagcggataaaacacggtgctgccatcaaagccgcgcgcgccaaccagcgacacttcaccagagaagttaatgccctgctcgacaatacattcgccgtaacactctgccggtaactgttcggtttcatttgcgcgtaaacgccattgaccgcgaccgtcataaccaccagtgcgacgcttaacaatcgccagctcacctaaacgatcaaacaccgcaggccactcgctgcgttcggcaagtaactgccacggtgcagtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcgtcggtctgggctttgcgccagtcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgcctggcagatgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagagcaaggaaaacggttgcgtggctgtgaaatcagcaaagttgcgggttttttaaaacggaaaatgaatcagctcaacgtcatccgccgtgactttcaccattgaaccttccgtatgccaggcacccagtaccacgcgaaaagcaggttgctgattggcgataagttcatgcaccgccgggcgatgggtatgcccgtggatcagccattgcacctgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgaggaatagcgtctgcagccagggtttgtggaccttggcgcgaaaagcctgataacccgcgtcatcggtgcacagcgtgtcgccatgcataatcaacacccggcgaccataaagttcgagcaccttttcttccggcaataacgtcatgccactttcacgggcaaagcgtttgccgagcagaaaatcacggttgccatgaatgaaataacagggaacgccggaatcggacaccgctttgatcgccgccgccatcttgcgatggagtgggttgggatcgtcgtcgccaatccatgcttcaaacagatcgccaagaatatacagcgcgtcggccttgcgggcttcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgcaacacctttgattttgtctaccacgtccatgccgtcaaccacttcagcaaacacgcagtagccccaaccttgcaggctttcgccagagaagttcaggaagtcgttatcaaccacgttgatgaagaactgtgcagttgcagagtgcggagcctgagtacgtgccattgccagcgtaccacgggtatttttcaggccgttgttggcttcgtttttgatcggttctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccagttcgggtcatatatagggtggtgttatagcataaccgcacgatcggatcatcacgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcttttgacgtggttgcgcgctatctgcgtttcctcggctataaactgaagtatgtgcgcaacattaccgatatcgacgacaaaatcatcaaacgcgccaatgaaaatggcgaaagctttgtggcgatggtggatcgcatgatcgccgaaatgcacaaagattttgatgctttgaacattctgcgcccggatatggagccgcgcgcgacgcaccatatcgcagaaattattgaactcactgaacaactgatcgccaaaggtcacgcttatgtggcggacaacggcgacgtgatgttcgacgtcccgaccgatccaacttatggcgtgctgtcgcgtcaggatctcgaccagctgcaggcaggcgcgcgcgttgacgtggtcgacgacaaacgcaacccaatggacttcgttctgtggaagatgtcgaaagagggcgaaccgagctggccgtctccgtggggcgcgggtcgtcctggctggcacattgaatgttcggcaatgaactgcaagcagctgggtaaccactttgatatccacggcggcggttcagacctgatgttcccgcaccacgaaaacgaaatcgcgcagtccacctgtgcccatgatggtcagtatgtgaactactggatgcactcggggatggtgatggttgaccgcgagaagatgtccaaatcgctgggtaacttctttaccgtgcgcgatgtgctgaaatactacgacgcggaaaccgtgcgttacttcctgatgtcgggccactatcgcagccagttgaactacagcgaagagaacctgaagcaggcgcgtgcggcgctggagcgtctctacactgcgctgcgcggcacagataaaaccgttgcgcctgccggtggcgaagcgtttgaagcgcgctttattgaagcgatggacgacgatttcaacaccccggaagcctattccgtactgtttgatatggcgcgtgaagtaaaccgtctgaaagcagaagatatggcagcggcgaatgcaatggcatctcacctgcgtaaactttccgctgtattgggcctgctggagcaagaaccggaagcgttcctgcaaagcggcgcgcaggcagacgacagcgaagtggctgagattgaagcgttaattcaacagcgtctggatgcccgtaaagcgaaagactgggcggcggcggatgcggcgcgtgatcgtcttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgacttttatcacctgccagggagcgaaaaagcgttcatctgaccacggccacagccagccaacgcctttaccgccagtggttaccgaatccagcaagctgtgcgatagcaacgagacggttaaaaacagccagcagcgaatcagcccagccctgaaccatcggcgtccaataaacacacataacagcgggacaacaaacgcaaacaccagcgaatgggtaaacccgcgatgaccaaaaacattgccgtaagcaacgccaaatttaaacgacaatacgtcggcgtcgggcagcatcgccaggatgattccggcaaataacagacgcggagggatgactttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacgattttgcagcgtttgcgcgtttcaaccgcaccgtcgactttcacctggccttcggcaatcgcgattttcgcctgcgcgccgctttcgctccagccttccagtttcagcaagtcgcacagctcaacgtgcggatgtttacctaaagaaaatgtcgccatgttactcatcctgtggatcatgatattcaacgcacgcctgtagcgtgttttcaatcagcgtggcaaccgtcatcgggccaacgccgccgggaacaggcgtaatgtatgaggcgcgtttagccgcgtcttcaaacacgacgtcgcccacaactttgccattttccagacggttgatgccgacatcaatcacaattgcgccttctttgatccagtcaccgggaataaagcctggcttgccaacggcaacgatcaatagatcggcattttctacgtgatgacgcagatttttagtgaagcggtgagtcactgtagtggtgcaacctgccagcagcagttccatgctcatcgggcggccaacgatattcgatgcgccaatcaccacggcgttgaggccgaaggtatcaatgttgtaacgctcaagcagcgtgacgataccgcgcggggtgcagggacgcagacgcggcgcgcgctggcacagacgaccgacgttgtaaggatggaaaccgtccacgtctttgtccggatgaatacgttccagcactttgacgttatcaatacccgccggtaacggcagttgaaccagaatgccatcgatggtgttgtcggcattcagcgtatcgataagctccagcagctccgcttcgctggtggtttccgggaggtcataagagcgggagacgaacccgacttcttcacaagccttgcgtttgcttgcgacataaatttgcgatgcagggttactacccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtagatcgaaggggatgcgcctattttgtcagaagcggggcgcgctgtcaggtttcgtttcagatttatcgcgtgaagcgacctcttgcgaaggtgaggcgcaccgtcgctgagactgaaagcttcatttttcgtccatgatggcgttgtaaatctggaactgatttatttccttgtctaaggattaagataatttaagaaatacctgacaatataaaaagaattttcagcctggtaatttaccgcttcaggtctatatttgtgttgaatatattttgcgcggaagtattcatctaacggggctctctattttttagaatagagtgcatattttcaattaagacattcttagaggataaaaaggaatttactactatcagtgtcttaaataaagtaatcggttatatacggatgtggagtcgataaatgagattgaaggaatatatatgaaattaagatttatttcgtctgcgctggctgccgcactattcgccgctacgggtagttatgctgccgttgtagatggcggtacaattcactttgaaggcgaactggtgaatgctgcctgttcagtgaatactgactcggcagaccaggttgtcacactcggtcaatatcgtaccgatattttcaatgctgttggtaatacctctgcattaattccattcaccattcagttgaacgactgcgatcctgttgttgccgctaatgctgccgttgcattttctggtcaggctgatgcaatcaatgataatttattggccattgcatccagtaccaatacaacaacagcaacgggtgtcggtattgaaatacttgataatacatccgcaattctcaaacctgatgggaatagcttctcaaccaaccagaacttgatccccgggaccaacgttcttcatttttctgcacgttataaaggcaccggtacaagtgcatcagcagggcaagcaaatgctgacgcgacttttattatgagatatgaataatcaaaaccacgttgttttgaattatatatcacgtcttataacaaagtaatgtaccggttgtctgaagcggtatggtggcaatgtaaatcgaaatcatgttcactttgtatcatgccgctttattaaatgaaaagggaatgatgtgttgtaagaaaccaaagcaatcatttctttatattccttatttttgccgtcaggaatacacaaggcgtattaactatgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaatactttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccggacacactcaagttttcgcgatccggtaactatatcaatgttcataatccatcacctttttatgtcaccctggttaacttacaagtgggcagccaaaagttggggaatgctatggctgcacccagagttaattcacaaattcccttaccctcaggagtgcagggaaagctgaaatttcagaccgttaatgattatggttcagtaactccggtcagagaagtgaacttaaactaaccgaatcatctgacaatatcagagctaattatgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcgcaggatatcgtatttgaatcgacaacagaaaatacaggtgataaatcaggtgggttaatgccctgttttaaccaggtacttcttgaacgaattggccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttctgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaatctcgggaactggggcgcagtgtcgctggatgtaacgcatgcgcgcagtcagttagccgacgccagtcgtcatgagggggattctattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgacggtgagcatcgcgatgaaccgataatcgtgaattaccacaatttacgctttagccgtaaagaccgtttgcagttaaatgtttcacaatcacttaatgactttggctcgctttatatttctggtacccatcaaaaatactggaatacttcggattcagatacgtggtatcaggtggggtataccagcagctgggttggcatcagttattcgctctcattttcgtggaatgaatctgtagggatccccgataacgaacgtattgtcggacttaatgtttcagtgcctttcaatgttttgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtacacgggcagcgccacggcaaactggcaggccgcttacggtacgctggggggcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgctgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcggaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcactgttatttcggcagtttgcacacatcctggctcataaaggaaattatcaataagataatctgcagattattattggcgatggcatgtttgtgtctggcaaacatatcctgggctactgtttgtgcaaatagtactggcgtagcagaagatgaacactatgatctctcaaatatctttaatagcaccaataaccagccagggcagattgttgttttaccggaaaaatccggctgggtaggtgtctcagcaatttgtccacccggtacgctggtgaattatacataccgtagttatgtcaccaactttattgttcaggaaactatcgataattataaatatatgcaattacatgattatctattaggtgcgatgagtctggttgatagtgtgatggatattcagttccccccgcaaaattatattcggatgggaacagatcctaacgtttcgcaaaaccttccattcggggtgatggattctcgtttaatatttcgtttaaaggttattcgtccctttattaacatggtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgatcacgcctaacgatctcaatagcgttattcctttccgtctggatgcagctgcggcagccaatgtcacacttcgcgcctggcctatcagtattaccggtcaaaaaccgaccgaagggccgtttagcgcgctggggtatttacgcgtcgattatcaatgaggtacggagaatgagaagagtactctttagctgtttctgcgggctactgtggagttccagtggatgggcagttgaccctttaggaacgattaatatcaatttgcacggtaacgttgttgatttctcctgtaccgtaaacacagcggatattgataagacggtagatttaggcagatggcctacgacacaactactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaatattatattaattcgtataatttggcgtagtcgataagctctacaattgaatgcaaacctagcttgccataaatattagatttatgcgcactaactgttttattgctaagtaataacttatcggcaatttctttattagataatccgctaaccagataacgtaatatggtcacttcacgattagatagcacagtgaccgttgaactattcgtactacatttattgctttttatatagttaagcgtttcgctgggaaaaaacgtgtatccggagaggatcatctgaacggcatgaaaaatatcattctgatcattgcatttactgacaaaaccgttagcaccagcttgtatcgctctgccagcataaaagcattctgatttcgatgataaaaataacactttcactgtgctctggatttgtttgatccttttcaggaaggtaaaaccgtctgttccgggcaagtctatatccataatgattaaatcaacaggacgggttcggagataatcgatggttatgcgataatcatccgttttcaggacaatctgcaattcactgtttttttgcaacagaacttcaatagacattctgatgataggatgagtatccataatgatcaccgacgttggtttcatagttaccagtctcataggagcggacaattttccgttaggtcgggaaattgtactttgatacatgaaaatacgggttttcttgattcagacgcgcagcggtgtgcgtttgtttgccgctatagcgaaataaatcagaaaatcagacgcggtcgttcacttgttcagcaaccagatcaaaagccattgactcagcaagggttgaccgtataattcacgcgattacaccgcattgcggtatcaacgcgcccttagctcagttggatagagcaacgaccttctaagtcgtgggccgcaggttcgaatcctgcagggcgcgccattacaattcaatcagttacgccttctttatatcctccataatttcagagtgggacatatttgggacattatcaccaaaaatgtcgtctattttcctcgcatgctctgtcaaatgattaggcgcaaggtgagcatacctacgaaccatttctatggactcccatccgcccatttcctgaagcactgataatgggacgcctgactgaatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcagttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgtttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaggcttgccgtgttgtgaggtacccggatattatcgtgaggatgcgtcatcgccattgctccccaaatacaaaaccaatttcagccagtgcctcgtccattttttcgatgaactccggcaccatctcgtcaaaactcgccatgtacttttcattccgctcaatcacgacataatgcaggccttcacgcttcatgcgcgggtcatagttggcaaagtaccaggcatcttttcgcgtcacccacatgctgtactgcacctgggccatgtaagccgattttattgcctcgaaaccaccgagccggaatttcatgaaatcccgggaggtacgagtattgccggaagcgtggcctgtatccggatgcagagtcttatccgtggaaatcgaacgcgcattactggttggttaccaacttgtaccagaacatgcgggccaatgcgctggctgacgcggaattacggcgcaaggctgccgatgaactgacctgtatgacagcgcgaattaaccgtggtgagacgatacctgaaccagtaaaacaacttcctgttatgggcggtagacctctaaatcgtgcacaggctctggcgaagatcgcagaaattaaagctaagttcggactgaaaggagcaagtgtatgacgggcaaagaggcaattattcattacctggggacgcataagagcttctgtgcacaggacgttgccgcggtaacaggcgcaaccgtaatctgatcttacccagcaatagtggacacgcggctaagtgagtaaactctcagtcagaggtgactcacatgacaaaaacagtatcaaccagtaaaaaaccccgtaaacagcattcgcctgaatttcgcagtgaagccctgaagcttgctgaacgcatcggtgttactgccgcagcccgtgaactcagcctgtatgaatcacaactctacaactggcgcagtaaacagcaaaatcagcagacgtcttctgaacgtgaactggagatgtctaccgagattgcacgtctcaaacgccagctggcagaacgggatgaagagctggctatcctccaaaaggccgcgacatacttcgcgaagcgcctgaaatgaagtatgtctttattgaaaaacatcaggctgagttcagcatcaaagcaatgtgccgcgtgctccgggtggcccgcagcggctggtatacgtggtgtcagcggcggacaaggataagcacgcgtcagcagttccgccaacactgcgacagcgttgtcctcgcggcttttacccggtcaaaacagcgttacggtgccccacgcctgacggatgaactgcgtgctcagggttacccctttaacgtaaaaaccgtggcggcaagcctgcgccgtcagggactgagggcaaaggcctcccggaagttcagcccggtcagctaccgcgcacacggcctgcctgtgtcagaaaatctgttggagcaggatttttacgccagtggcccgaaccagaagtgggcaggagacatcacgtacttacgtacagatgaaggctggctgtatctggcagtggtcattgacctgtggtcacgtgccgttattggctggtcaatgtcgccacgcatgacggcgcaactggcctgcgatgccctgcagatggcgctgtggcggcgtaagaggccccggaacgttatcgttcacacggaccgtggaggccagtactgttcagcagattatcaggcgcaactgaagcggcataatctgcgtggaagtatgagcgcaaaaggttgctgctacgataatgcctgcgtggaaagcttctttcattcgctgaaagtggaatgtatccatggagaacactttatcagccgggaaataatgcgggcaacggtgtttaattatatcgaatgtgattacaatcggtggcggcggcacagttggtgtggcggcctcagtccggaacaatttgaaaacaagaacctcgcttaggcctgtgtccatattacgtgggtaggatcaaccagcataaatcaggctgcggctaaaatggcgcgggcaggaatcctggtcgttgatggtaaggtctggcgaacggtgtattaccggttcgctaccagagaagaatgggaaggaaaggtgagcacgaatctgatttttaaggagtgtcgccagagtgccgcgatgaaacgggtattgagggtatataaaagaacatcaatgggaacacaatgatgaaacaggtgagttgagttcaaactgtagtacaattctctccagtttgaacaggaaagaatatgctatgaacccttatatttatcttggtggtgcaatacttgcagaggtcattggtacaaccttaatgaagttttcagaaggttttacacggttatggccatctgttggtacaattatttgttattgtgcatcattctggttattagctcagacgctggcttatattcctacagggattgcttatgctatctggtcaggagtcggtattgtcctgattagcttactgtcatggggatttttcggccaacggctggacctgccagccattataggcatgatgttgatttgtgccggtgtgttgattattaatttattgtcacgaagcacaccacattaaaataatttgtttctaaacgactaaaatatggaggctcttatatttatatgagcctcgttttatgctttttgttaatgtctttattttttatgtattcttttgtgctttcaagattatggcgtaagaaaattgcaatacgattattgttgtatattcaagataatgtgaccttaattgtctttttaaataaaaaataaacaaaaattatatcccaccactaaggtttataaaagcatacgttagcaggtgtcaccatgaaaaaagccatagcatatatgcgattttcatcaccaggtcagatgtctggcgactcattaaaccgacagagaagacttattgctgaatggttaaaggtaaatagtgattattatcttgataccataacatatgaagatttaggattaagtgcattcaaaggaaagcatgcacaatcaggagctttttcggaatttttagatgctatagagcatggttatatattgccaggaactacattgttagttgaaagtctggacagactttcaagagaaaaagtcggtgaagcgattgaacgtctgaaattgattttgaatcacggtattgatgttataactctttgcgacaatacagtctataatattgactctttgaatgagccatattcattaataaaagccatacttatagcacaaagggcaaatgaagaaagcgagataaagtcaagtcgggttaaattatcatggaagaaaaaacggcaggatgcactggaatcaggtacgattatgacggcgtcttgtccgagatggctctccttagatgacaaaagaacggcttttgttccagaccccgacagggtgaaaactattgagctaatttttaaactcaggatggaaaggcgctcattgaatgcaatagccaagtatttaaatgatcatgctgtaaagaatttctcaggaaaagaaagtgcatggggaccttctgtaattgaaaaattattagcgaataaagctctgataggtatttgcgtaccttcatatcgtgcaagagggaaagggataagtgaaatcgctggctattatcccagagtcatatcagatgatttgttttacgctgtacaggaaattcggttggcaccttttggtattagcaatagtagcaagaatcctatgctaataaatctacttcgaacagttatgaagtgtgaggcttgtggtaataccatgattgttcatgcggtatctggaagtttgcatggctattatgtttgtccgatgagaagattacatcgatgtgacaggccatcaataaaaagagatttggttgattataatatcattaatgaattgctttttaattgtagcaaaattcaaccagttgaaaacaagaaagatgctaatgaaactttagagttaaaaattattgagcttcagatgaaaattaataatttaatcgttgcattgtctgtcgcgcctgaagttaccgctatagcagagaaaataagactattagataaggaattacgaagggcttcggtatcattgaaaactttgaagagtaaaggtgtaaattcattcagtgatttttatgctattgacttaaccagtaaaaatggacgagagttatgccgtacacttgcctataaaacattcgaaaaaatcataattaatacggataataaaacctgtgatatctattttatgaatggcattgtttttaaacactatcctttaatgaaagtaatatccgcccagcaggcgataagtgctctcaaatatatggttgatggtgagatttatttctaaataatgatctcggattttaagttatgctatggtgataaagtgcaagacagaattaattatctttgacgaaacttaatgggtaattactttgtttgctcccacaagcgagttttgtacggctgtattggggtagtaaatgagctatacaatcttaatcatttgttaggtgagaactcttggtcgcagattcaaatactgaaaatacgtgacaaattattatgagcaaaatggtgtatgtcacgtattttgaatggtaggttaaaaaataacaccgactttcgtaggtgttactaataataaagcagagtttttagatagtatcaatgtgctttgtgtatattgtggcaaataattgggttgggggtacaattgtgattgcttttgcatgaacattgcgcctttatgcataatgagataaaggaatatcaaataaaataacgataggtcataacaaagaggtttttatgaaaacacttatcgtttcaactgtattggcattcataacattttctgcgcaggctgcagcatttcaggtcactagtaatgaaataaaaacaggagagcaacttacaacgtctcatgtcttttctggatttgggtgtgaaggtggtaatacatcgccctcattaacctggtctggtgttcctgaaggtaccaaaagctttgccgtaactgtatatgatccagatgcacctacaggcagtggttggtggcattggactgttgttaatattccagcaacagtaacatatttgcccgttgatgcagggagacgtgatggaacaaaactgccgactggtgctgttcaaggccgaaatgattttggctatgctgggtttggtggcgcatgtcctcctaaaggagataaaccacatcattaccagtttaaagtatgggctctaaaaactgaaaagattcctgtagattctaactccagcggagcgttagttggttatatgcttaatgctaataaaatcgcaaccgctgagataacaccagtttatgagataaagtagggtgagagtatgctggcaagaggtaagactaacttaaagatcgaagaaatacggatgcataaacatcatgagattcatagggttaagcctcttatgccagctttgtgtcgtatccgtcagggaaagaaagttatcaattgggagacgcatactttaactgttgataataatcaaataatattatttccttgtggttatgaattttatattgagaattatcctgaagcagggctttatcttgcagaaatgctttacttacccattgatttaattgagagtttccaaaaactttatacggtaactgatcaaatacgtaacaaaacaagtttctttttacctcagaatcctgagttaatatattgttgggagcaactaaaaacatctgtttcccgaggcttctcaactaaaattcaggagcacttagcaatgggcgttctactttcgttaggagtgaatcatgttaatcatttacttttatcatatagtaaacaatcattgataagtcgttgttataacctgctgctatccgaacccggcacaaaatggacagcaaacaaggttgctcgatatctctacatttctgtttctacattacatcgccgtctagcaagcgagggggtaagtttccaaagtatactggacgatgtgaggttaaataatgcgttgtctgctatacaaacgacggtaaaacctataagcgagattgccagagaaaatggttataagtgtccttctcgttttactgaaagatttcataatcgttttaatataacaccaagagagataagaaaagcttccagagagtaaaagtgttttaagaaggagcaattctatcgattttgattttgggaaatcaacacggcataattatgtcaccggagcctgaacaactccggtgacttctgcgctaaacggggacgtttatgcgcacatacaatccaaactctcttctcccttcacagatgcagaaatgcacctgcaattctttgcatctagcgtttgacctctgcggaggggaagcgtgaacctctcacaagacggcatcaaattacatcgcggcaacttcaccgctatcggtcggcagatccagccttatctggaggagggcaaatgctttcgcatggtgcttaaaccgtggcgtgagaaacgcagtctttcccagaatgcactcagccacatgtggtacagcgaaatcagtgaatacctcatcagcaggggtaaaacgttcgccactccagcttgggtaaaagatgctctcaaacacacatatctcggttatgaaaccaaagacctggttgatgtcgtaaccggtgatatcaccactatccagtcgttacgccatacctccgatcttgataccggagagatgtatgtcttcctgtgtaaggttgaagcctgggcgatgaatattggttgccacctgactattccacagagctgcgagttccagctgctgcgcgacaagcaggaggcgtaatggctacaccgcttattcgtgtcatgaacggacacatctacagagtaccaaatcgtcgtaagcgtaaacctgagctgaagccatccgaaataccaacactgctcggatataccgccagcttggttgataaaaaatggttgcgactggcagcaaggaggagtcatggctgatttgagaaaagcagcgcgtggtcgggaatgccaggtaagaatccctggcgtatgtaatggcaaccctgaaacgtctgtactggcacatatccggctgactggattgtgcggcaccggtacgaaaccgccagacctgattgccaccattgcatgttctgcctgccacgacgaaatcgaccgccgcacgcattttgttgacgctggatatgcaaaagaatgcgcgctggaaggtatggcgagaacacaggttatctggctgaaagagggggttattaaggcgtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatgatgtttgagtttaatatggcagaacttcttcgccaccgctgggggcgtctgcgcttatatcgtttccccggttctgttttgaccgattaccgaatactgaagaattacgccaaaaccctgacaggagcaggagtatgaagtcagagataacaatcaactaatactgttttgttgatttttgcttgtaattggcgttctggtctgatttttgtggagtaagttgatgcgtgatattcagatggttcttgagcgttggggagcgtgggcggctaataatcatgaagatgtgacctggtcgtccattgccgccggttttaagggattaattacttcaaaagtaaaatctcgcccgcaatgttgtgacgatgacgcgatgatcatttgcgggtgcatggcccgtctgaaaaagaacaacagcgatttgcacgatttattagtagattattatgtagtcggtatgacattcatgtcactggcaggtaagcattgctgctctgatggttatatcgggaaaaggttacagaaggctgagggcataattgaagggatgttaatggcattagatatccggttagagatggatatcgttgttaataactctaattaatatgccaattgtttactaaaaattattaaaaatggggcgttgagacgcccccaaaaataaagggtaatatataacagaaggtttatatagttagaagcaaggttgtgcttctaaaggaagtggcttgagggagccacttatatgttggggaggcaacgcctcccgcaacatatctttttcgtaatcagattagaactggtaaaccagacctacagcaacgatgtcatcagtgcttacaccgagtgctttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtgaagtcatttttgtcaagcaggttgattttgtaatcaacgaaagtagacatatttttgttgaagtaataggttgcacctacatcaacatatttgactaagtcctgatcgccccatactccaagatccttacctttagattgcaggtaagcaacggacggacgcagaccgaaatcgaactgatattgtgcaacagcttcgaagttttgggctttattagcaacgaagtgatcagcaaatacagtcatattctgggtttcagaataggtagtggccaggtaaatgttgttagcgtcatatttcagacctgcggcccaaacttctgcatttttaccggaagcaaatacttcaggaagaactttccctgcattaacttgagtgtcggtacgatcagatttcgcataagttgcaccgataccgaatccttcgtattcataggtagcagagaaaccgaagccatcaccgttaccttcagtgtagttatcgaaatcgctacgatcgtttttgccttggtactgagcagcaaagttcagaccatcaaccagaccaaagaagtcgttgttacgataggttgcaacaccagttgcacgttgagtcatgaacacgtcggtttgagtccaagtgtcaccaccgaattctggcaggacgtcagtccacgcaccgatgtcgtatgctacaccgtagttacggccgtaatcgatggagccgtagtcaccgaatttcaggccagcgaaggcaagacgggttttatctttggaggaaccttgagattcagcgcggttgcctttgaattcatattcccactgaccgaaaccagtcagttgatcgttgatttgggtttcacctttgaagccaagacgggcataagtagtatcaccatcatctgcatcattagaggagaagtagtgcttagcattaactttcccgtacagatccagcttgttactgtctttattataaatttcagctgcctgagcagacatcgccattagtactgatgcagctacagcagaaattgccactgttaattttttcatcgtgagccctttttttgaactattattaaaaaatgatgtcactgcgcgataaatattcatctaatcaatgtgattatttcaagatgtaagttttggtttctcgtttgatttgtgaagtagatctctatttttatctgaacttttttctatcgaatcctattcatggctcttggctgaataaaaataaatctattagccaatttatattaacggctgttatttataagtgctctataatttgaaggttcaatttaaaccggctaaaaataacactggaaattattttttggttatttgttgagatttgcttatgtatttgtagtggtgttttcaatactcggtagcattctctcaaatatcatttagtggtttacgtacgtaaaaaattggttatgctgttaagagtggttacttcgtcacacagcttaaacccgccgtcgagcgggtttttccattttttgagtctcgatattagctgataacccaatacctgagttattcactgactccgagtctgttacgtttcgtagtattccctcaatttacacccgctttgtctgcgaggtggggttatgaaatccatggataagttaacaacgggtgtcgcctatggcacctcagcaggtagtgccgggtactggtttttacagctgctagataaagtcactccctcacagtgggcagcaataggtgtgctgggtagcctggtatttggcctgctgacgtacctgacaaacctttatttcaagattaaagaagataagcgcaaggctgcgagaggtgaataatgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacggacacaccggaaaagacatcatgctcggtaaaacgtataccaaagcagaatgcaaagcactcttgaataaagaccttgccactgtcgccagacaaattaacccgtatatcaaagtcgatataccggaaacaacgcgcggcgctctttactcattcgtttacaacgtgggtgctggcaattttagaacatcgacgcttcttcgcaaaataaaccagggcgatatcaaaggcgcatgtgatcagctgcgtcgctggacatacgctggcggtaagcaatggaaaggcctgatgactcgtcgtgagattgagcgtgaagtctgtttgtgggggcaacagtgagcagagtaaccgcgattatatccgctctgattatctgcatcatcgtcagcctgtcatgggcggtcaatcattaccgtgataacgcaatcgcctacaaagtccagcgcgacaaaaatgccagagaactgaagctagcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccacggcctccggcgtggataatgcagcctccccccgactggcagacaccgctgaacgggattatttcaccctcagagagaggctgatcactatgcaaaaacaactggaaggaacccagaagtatattaatgagcagtgcagatagagctgaccatatcgatgggcaactcatgcaattattttgagcaatacacacgcgcttccagcggagtataaatgcctaaagtaataaaaccgagcaatccatttacgaatgtttgctgggtttctgttttaacaacattttctgcgccgccacaaattttagctgcatcgacagttttcttctgcccaattccagaaacgaagaaatgatgggtgatggtttcctttggtgctactgctgtctgtttgttttgaacagtaaatgtctgttgagcacatcctgtaataagcagggccagcgcagtagcgagtagcatttttttcatggtgttattcccgatgctttttgaagttcgcagaatcgtatgtgtagaaaattaaacaaaccctaaacaatgagttgaaatttcatattgttaatatttattaatgtatgccaggtgcgatgaatcgtcattgtattcccggattaactatgtccacagccctgacggggaacttctctgcgggagtgtccgggaataattaaaaacgatgcacacagggtttagcgcgtacatgtattgtattatgccaacaccccggtgctgacacggaagaaaccggacgttatgatttagcgtggaaagatttgtgtagtgttctgaatgctctcagtaaatagtaatgaattatcaaaggtatagtaatatcttttatgttcgtggatatttgtaatccatcggaaaactcctgctttagcaagattttccctgtattgctgaaatgtgatttctcttgatttcaacctatcataggacgtttctataagatgcgtatttcttgagaatttaacatttacaacctttttaagtccttttattaacacggtgttatcgttttctaacacaatgtgaatattatctgtggctagatagtaaatataatgtgagacattgtgacgttttagttcagaataaaacaattcacagtttaaatcttttcgcacttgatcgaatatttctttaaaaatggcaacctgagccattggtaaaaccttccatgtgatacgagggcgcgtagtttgcattatcgtttttatcgcttcaatctggtctgacctctttgtgttttgttgatgatttatgtcaaatattaggaatgttttcaattaatagtattggttgcgtaacaaagtgcggtcctgctggcattctggagggaaatacaaccgacagatgtatgtaaggccaacgtgctcaaaccttcatacagaaagatttgaagtaatattttaaccgctagatgaagagcaagcgcatggagcgacaaaatgaataaagaacaatctgctgatgatccctccgtggatctgattcgtgtaaaaaatatgcttaatagcaccatttctatgagttaccctgatgttgtaattgcatgtatagaacataaggtgtctctggaagcattcagggcaattgaggcagcgttggtgaagcacgataataatatgaaggattattccctggtggttgactgatcaccataactgctaatcattcaaactacttaacctgtgacagagccaacacgcagtctgtcactgtcaggaaagtggtaaaactgcaactcaattactgcaatgccctcgtaattaagtgaatttacaatatcgtcctgttcggagggaagaacgcgggatgttcattcttcatcacttttaattgatgtatatgctctcttttctgacgttagcctccgacggcaggcttcaatgacccaggctgagaaattcccggaccctttttgctcaagagcgatgttaatttgttcaatcatttggttaggaaagcggatgttgcgggttgttgttctgcgggttctgttcttagttgacatgaggttgccccgtattcagtgtcgctgatttgtattgtctgaagttgtttttacgttaagttgatgcagatcaattaatacgatacctgcgtcataattgattatttgacgtggtttgatggcgtagatgcacgttgtgacatgtagatgataattattatcattttgtgggtcctttccggcgatccgacaggttacggggcggcgacctcgcgggttttcgctatttatgaaaattttccggtttaaggtgtttccgttcttcttcgtcgtaacttaatgtatttatttaaaataccccctgaaaagaaaggaaacgacaggtgctgaaagcgagctttttggcctctgtcgtttcctttctctgtttttgtccgtggaatgtgcaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaggttgaagaactgctgcaggccagcgagacagatctccagccagggactattgagtacgaacgccatcgacttacgcgtgcgcaggccgatgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttattccagctggcttcgtggctgttttcaacagtgatgagtcatcgtggcatctcgttgaagatcatcggggtaaaacggtttatgacgtagcgtcaggggacgcgttatttatttctgaactcggtccgttaccggaaaatgttacctggttatcgccggaaggggagtttcagaagtggaacggtacagcctgggtgaaagatgcagaagcagaaaaactgttccggattcgggaggcggaagaaacaaaaaacagcctgatgcaggtagccagtgagcatattgcgccacttcaggatgctgtagatctggaaatcgcaacggaggaagaaacctcattgctggaagcctggaaaaaatatcgggtgttgctgaaccgtgttgatacatcaactgcacctgatattgagtggcctacgaaccctgtcagggagtaatcattgggattatgccgcagcacgtcttaagcaagaacatgctgcggttggatgctatttttttcctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaagacatggaaatggaatcaaattgaccatgtaacgccgcgggataaggttcaaaaacatcatggctaattttatgtttaatttttgattccccagcccttgtagatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattctagccccatcatctgtgtttttttattaatttcaccatgttatagttttatttgtgaattaaatcaattatggcaatgaattacaaggggttaaatgctgccgcagcatagcgatattgaaatagcctggtatgcttcaatacagcaggagccgaatggctggaagaccgtcaccacacagttctacatccaggaattcagtgagtatattgcgccactgcaggatgctgtagatctggaaatcgcaacggaggaagaaagatcgttgctggaagcctgaaaaaagtatcgggtgctgctaaaccgtgtggacacttccgtagcaccagatatcgagtggcttattcaaccataataaacagtatgtatatcataggttattaattgtgagttttttcggtgtgttatttgtttgtttgatgttatgcttttgcgccccaaaaggttgtttagatgtattttatcaattgattttcaatatcgtttaataaagaaaaattaagcaagctggatgttggttttttgttaattgaatggttctaataatgtttttttactgttgttgaatgtgacttgataagaaatgcaagtaaaaatgatactctttttattttaaattcaaacggttgacatatatatagcaagaggtttcaggtgcgttgtagtgagtttatgttaataaaaagcatagtaagcgttgaaaaatgtaactttgaaataagttagaataaaaaacaacatacatataataatttaatcttaaatgaaatttattaaaatttgcaaactataattttgtgtataaaaatataaatgcacatcatcctgattatgattgtgtatttaattggttgttatttgactactatcaacttgttttaattttatgataggtgcaagatggattatgtttgctccgtagttttcatctgtcaatcatttgatttaattataaacaggagagttatctcgttcaaaaaaaattcattgtttattgtaagcgacaaaattagaagggagttaccagtatgcccctctaaactaagaattgttgatatagataagaaaacatgtttatccttttttatcgacgtgaataatgagctgcctggcaaatttactcttgataagaatggctatattgctgaagaggaacctccattatcgcttgttttttctctgtttgaagggattaaaatagcagactcacactccctttggttaaaagaaagactatgtatatccttacttgccatgttcaaaaaacgcgaaagtgtaaattcatttatactaacaaatataaatacatttacctgtaaaattactggaataatcagttttaatattgagcggcaatggcatttaaaagatattgcggaattgatttatacgagtgaaagtttaataaaaaaaagattaagggatgaaggaacgtcatttactgaaatattgagagatactaggatgaggtatgcaaaaaaactcataacttcaaactcttattctatcaatgtcgtagcccagaaatgtggctataacagtacttcatatttcatatgtgcatttaaagattattatggtgtcacgccatctcattattttgagaaaataatcggcgtcacagatggaataaacaaaacaattgactgataatgtttattacaagttgtctacatgttaattataatattatacagcgttttttttgatgtgatattctggaaccattaatttgtaattgggttgctgtcgcctattttatacatactataattgatggttttctatgtgatttagttaataaccttctgggtttattttaagggttaattgttacattgaaatggctagttattccccggggcgattttcacctcggggaaattttagttggcgttcttaaaatgtgtacttaagaccagcagtagtgatgaagttatagttttctatacctgctccatttttgctgtagtctgaagtgttattattgtgatcataaagtgaagtattaccttttttattcgtaacccgattccatgcgccttcaacataaacttttgcgttaggtgtgacgtaataacctgcattgactgcaacagaatagtaattttggtctttgaccttactgcgataagtgattctttttcccgggtcatagtgttcatcgttatcagatgattccacccagccgctgtatttaaatgtgccaccgagttcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagagttgtccagccagcagccccgatagatatctggggcatcaaatcccaattaattgcacctttaataattgcagcgttattgaatttccagtcgagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaataggggttgtcaggactattcccagaagtttcgcccgcataaaagttctccattcaatcgttttaatgattgaatatgtattttttatatctaacttaatgagtcaattacatattgctccactgtttatattttgtttagtattgaatgattatcacaatgcgctatctgtttttggtttaattatctgttattgtttcatatttcggttttactgtgtggtttttttatgcttttgtggtgcttttatctatttaagtgccatgcctttagaggcatataagcgaaaatagcatgaggtttatcctcaattactatgttttttagtacaaaaaagagggacaaaactgagacacataaggcctcgcaatggcttgcaaggctttacatgttttgaggtagtgggacgtgtgagcgcagagatggcgcggtaagttgttgacttaaaatgtcgttctaggaacttctaagtcgtgggccgcaggttcgaatcctgcagggcgcgccatttcttcctcatttatgcccgtcttatccgtttccgctttgcccttcaccacatcactttttgtcgctgtttggcgagataattcaacggtgtcaggccgtaaaacgccttaaaaacagagataaagtacgacgtgctgctatagccacataattgcgccacctgagtgatatttttgttatccatcaataacatctgtacggcgtaacgcatacgacactctgtgacaatctggctatagctggtattttcgttttttaatttctttttgagcaggctggggcttaaacatagcgaactggcgacaattcgcagattccagtaatgctgaatatcgctttgaataatgcggcagacgctgtcgcggacgctgctgcgtaagatatacatcagtagggcaataaaccgcgattgctcaagaaagttagacaatacggtaaaaagcaatgcgcgcgtcaactccgcttcgcagggtctgctgggttgctgcttgctgtggttggcggctagccggaacacttccggtgtacggctatgacaagcgataaccggggttgccagccgcgaccagggctttacacaggttaagttcttatttaaaaacaacagataatcgttgatgatgttacggttgatgtgggtgattaatacgtgatttaacgttgagagttcaatgacgttattgttgcacgcgaaggcggccaggtagtttttcggaagggtaaacgtagcatggttattgacgcttacctctacctctttttcggtcaggatcaccacgcaaggttcactgctgctcaattgcatttcgcactcctcagatatcagaaactccgctcaaaggatctatgcttcctgcatgagtgatcggcccgttcgccgataacgatcttctttctttagcacgctttttagcaattaatcttgatggaattctgatgagagcgaaagaggtaagccaggtcgtacccgacttacctggaggagatttaatactcgagaatgccgtgcgcgacgggcaaatagcgcagagagaaatagagagtgtctttaccgcaagaggaacgtttcgctaacagcgaggcaatttctgcgtccggtttcggtttcgctgtaaaggttttgcctttgccggcgacaaaaagttcataaacaacgccgctggcaggggcgggactttggcaatcggcgctggcctgtaaataacgttcacgctgttcagcggtcagtttatccacgccgctgccatcctgtacccagacattaacgccggttgctttaacgtgttccagcagttggcgatagccatcgggcgacatgtttccggcgaaaaaactactgatataaaccggttttgctgaaacatcgctaatcagccgctgcgcgttgtttaaccatgttagcaaaggctgacgggcggcttcgctgcgccagttcaggtcgtcaatttccgcgctgatgtaccagccatccggcgttatgccaggcgcggcgctccataatctggcttgctggagatcggcagccagcaggcgattaagatagctttccagcgctgcggacgactgtttctggtgcataaaaaattccggatcggcgttcagcccgacaataagcttcagaccagcctgttgcgcagctgcggcccgcttaaacaataacgtgcgctgttctggctgggtaaatgcatcgccgtaacgggtccattgcaaaacaagggtatcgaagccttgcaaacgtaactgactcatcagcccctgccactgggtatcggtaacctgactatctcggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatactcgacgccgagactgactttgtgcggccaggcgtcgtagtgcgtctcgccggtccagatattccagcggaccccgactccgccaagctgcgcgccctgagtgcctttatcacgatagccgttgtcctgaacgtgagcgtaaggctcaatagtctgtccgttagctaccttctgatgccagctgacgcgataatctgccgtccacgcctgaatatcctggcggatatattgcgccgcatcgaggtacaggttttgggcaaaccagcctgaaccgttcgggtgccattcgtcgctgtatttgccgccattaaagaatgaggcgctggcgcgcagcatggtatcggatgcgccattttggccgttcagcggcaactgctgttcgacggcgatgaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgatgcggtactcggcttccagttgtccgtagctacgatagcttttccctggcgctgcgccgccgacattattgttagcggtactcattgcgccggaacgcaagccgatggaagaatcgaaactgaacgtccagcggcgaccgacctcctcatgcaaacggcggaaattgaagcgttgttgattttgttctggggtcagtggggttatcagcgcctgattatcaatgtcatcaatcaccagccgggcgtagtgctgcgtcgcaggcatgtcatccagacgctggttcacgtaggccagttgtcggatcagtgccggatcgtccggaagccctttatgcgccggttcgagcatttcccgcgactgtgcgatatcaccgctatcccacaaggcgtaaccaagcgctgcctgggtgttgctattattcggttccagttccagcgcggcgcgcaaatcactcaccgcggccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgcttcccagtccacgtttttctgcctgttgtagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgctcggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaaagtctggctgacacgcgcatcgccctggaaaggatagcgttgcagcaataaatcggcagcttcgcgtgactgctcgttctgcatcagttgccaggttagttgatccaggcgggtaagatttgccggttcttgctgatacagcaatcgtgccagacgcagagcttcagccttgttacgggtcgccacgctgacagcataacgctcctcaagcatttcattggcggggagggtggcgagcagtttttgcgctgcgtcgtactgaccttcttttaacagcaccggtagcgtcgcgccaacaacatactggcggttgtcggcaaactgtaccgtataattcgccaacgcctgaacggggttagcgctgtatttagataacagatagagccaacttttctcttgtgcgtccgtggtaaatagtggcttattttcaatgagataatgctggaggcgtgctttttcgccacgataagccagcgcggtcgcgtaagtaatatatgactgaggatcggtgaagatcccctgtgattgcagtgccaggatccgatcgtccagctgcccggcaagaagcacgtcaaaccactgacggcgttctgccgcgcttaatgtgttctgctggcgtgcttcattgtatagcgtatctgcctgggaccattgtttcaggtagattgcccgttgcagcagatcggttcgcagcgtttttccttccggcgatgcagcaaacgtcgcatcgttcagttgcgctctggcgacaggtaactgtgccagccgcagggcattctgcccgacttcactgcgacaacgcagggtcggcgcagcatcgcacgctttttgctgggcaagcagttcttcaactgtcgtaacgcttttcacttcaaccggaatagccgccagactgcgctcaagtcgggcatctcctgggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgctttatcgagacggggataaataacaaaatggcgataatcgctcagccccagctcttctgcgctggtgccgatattgtctgcgagtgcgctggtactcaataaagacgtcagcagtaaaccagaccatccgatgacgcgattaaggttattctccttcattttcggactccagttgcgcaacctgttctgtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttcggcgaacaggaactgatgcggcacatattgccgccagatttcaccggcctgctgttccgtgagccactgatgctgaaccgcattgtacaacattgcccgcggatcgtgaccgcgtcggcgtgcataccagtgacgtaaccctgtgacaatttgtccccgcagaacaatgacgtaacgcactttgcgtccgactttacgcgtcagggccgccagcgaaaccgggtcaataccatcttcactgccgacaattaactcgtcattttccagacgcagcggcagtaccgcataatgcagcgccacggaggccggcatttcggcaatcagcgaggaagggatctgccaggcatcgatggattcccacgccacgccgttttgctctgccagcgcctgtgccagctgctcggcgctaatcagcccctgcatcagcattgaaccgcccaggcgtagaccttcgacgcgattacgcagtgctgtatcgagttgttcttcagtgatgacctgattttccagcagaatttgacctaacgggcgcaacgagcgggtatcgccagtcacgctggggaagtcatgcgttgttttatcccacgccacgcgacgtggatcgccgtgttgaagtacctgttttagcgcgcgccagttggccatgaagttaatcaggttgccccagaaaagacgcaggacggaaagcagcccctgcgtcaggccgtagtagccagtaacgaaaatcacccgctgcacgatgcggttaaccatcaaaccaaagtttagccacagcagggtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttatgggttttaaagccttggaaaacaatgccgatgatccagcgggatttttgtcgaaccgcagtcgaaaaggtatcggggaaatattcgcgcacgcagatcatgtttgatgtccgcgcgtgctgtaaaaatttacgctgctcgcgttctttggcttcgtccaccaccggaaaacggacaaaaatttccgtcatacctttttctttcaggcggaagccaatgtcgtaatcttcagtaagactctgcacgtcgaaagcaataccgtcaccgtcagctaacagtgcggtcacggcgcggcggctgaaacaggtgccgacgcctgcgctgggcacttgtccggcgagggcttcacgcaccggaacatctttgccatgcagctctgaaaactcatcaatgtaagtcatgctggtgaagtgcgtccattcgcgttcgaacggatacaccgggatctgaatcagatctttacgctcgaccagatagttgaacagacgcaattccatcggtgaaatcacatcttcggcgtcatgcagaataaaaccagcaaaagcgaaattggcgctacgctcaaattgggtgatggcgtccagcacgttgttcagacagtcggctttgctggtggggccaggacgcgcgcagactaccttatgcacattcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacatgatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttaccattaataggtatgactattgcggcacgttatttttacactggttataaaagttgccgtttgctgaaggattaagcgggtaatgtgataacaaaccttgtcccccgcgcatccgacgttaccgcaaccgtgcctttatgcgcgacaacaatcgatttcactatcgccaggccaataccgctaccttcaccttttcgctggcgggaggggtcaacgcgatagaaacggtcaaacaatcgcggtaagtgctcgggcgcaatgggcgtaccggggttttcgacgataacttgcaccaggtgatcgaccgtctgacagcgcactacaattgtctctccggttggcgtataacgcagggcgttcgaaagcaggttgcttagcgcccgacgcagcatcagcggatcgcccgcgacctgacacttgtcgccaacaaaccgcaactccacgccgcgatcttccgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttcggtttgcgttatgagattcgtaattggtgtgcgaatttcgtgagcgatatccgctgagaaattggactggcgggtaaagacatcctcaatacgctcgatcatatggttgaacgacagtaccagctgttccagctcaatgggcacggtctgcgggtcgaggcgaacgtcgagatctttcgaggtaatattctggatttgacggctgacgctgcggatcggcgcgtgacctttatgtaccgccaacagtacgataaagacgatcaggatgctgattaccgatgcggtcataataagtttattcatcaaatcatttatgtaatgaagatgaaaatcgatcgaaagcgcgatgtagagcgtataaatcggtttgccgtccaccaacgggccaaccggcaagttaatcatccgccagttgctgtgttccatatgcccgtgaccgtggcctggcatcatcatcgtcgggccggaaaggagatacacctcgccaccctgagcgtctttatcgggtatggcgtcacgcgtaaactcgcggatatccggcgcaccgggggagtgatacaccgttttaccctgactatctgccagggaaatcaacacattggaataaccactgacgatatcttccagcgtcattaagcgtcgggcttgcgtttcgtcagggtgatttagtacccgttcaagggtggcgctaatctcttttaaatcattaatatcctgctcggcaaaatgaacttttactgagtggatcatgatccatgcaaaggcgaaaaacgccgcgatggtggccaggctgataaaaaaggtcaggcgggttgccagcgaaaacgggcgctgaaatggcttactgaccatccggcacctcaagcatgtaacccacgccgcgcacggtctgaattagcttcggctcaaagtcgttgtcgattttgccgcgcagccgcttcaccgccacatcaatagcattggtatcgctgtcaaaattcatgtcccatacctgcgaggcgataagcgagcggggcagcacttcgccctgatggcgaaggaagaactccagcagagtaaactctttactggtcaaagtgatgcgcgtgccgctgcgggtgactttgcggctgacgagatcgaccatcaaatcggcaacctgaaactgactttcgataatcaccgccgccccgcgccgcagtaatgtgcgcacccgcgccagcagttcagcaaaagcgaatggcttcaccaggtagtcatctgcccccaactccagccccttgacgcgatgttcaatggtgccaagcgcggtaagcaacagaatcggcatccctttattggcggagcgtaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcatttttctgtcaccggaaaatcagagcctggcgagtaaagttggcggcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgctggtgaataatcgggatttgcgcatggcgacgctgaaagtgcaggaggcacgggcgcaatatcgtctgaccgatgccgaccgctacccacagctcaatggcgagggcagcggcagctggagcggtaatcttaaagggaataccgccacgacacgggagttttcgaccggccttaacgccagctttgacctcgattttttcggtcgcttaaagaacatgagcgaagccgagcgacaaaattatttagccactgaggaagctcagcgcgcggtgcatattctgctggtttctaatgtcgcgcaaagctatttcaatcagcaactggcgtatgcgcaattgcaaatagccgaagaaacgctgcgtaattatcagcagtcatatgcgtttgtcgaaaaacaactgttgacaggtagcagtaatgttctggcgctggaacaggctcgcggggtgatagaaagtacccgcagcgacatcgctaaacgtcagggggaactggcgcaggcgaataatgcattgcaactgttgctgggaagctacggcaagctgccgcaagcgcagacagtaaacagcgacagcctgcaaagcgttaaattaccggcgggattgtcgtcgcaaatcttattgcagcgcccggatattatggaagctgaacacgcgttaatggcggctaatgccaatattggcgctgcacgcgcggcattttttccgtctataagcctgaccagcggaatatcgaccgccagtagcgatctatcgtcattatttaacgccagcagcgggatgtggaattttatacccaaaattgagatccccatttttaatgccggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaattagcgcccagcagcgttatctggcatcgctgcaaattactttgcaacgggcgcgggcattatatcagcacggcgcagtaagttatctggaagtgctggatgccgagcgttctttatttgcaacccgacaaactttacttgatctgaattatgcccgtcaggttaacgaaatttctttgtataccgcacttggtggcggttgacagcaatatactcgtcatacttcaagttgcatgtgctgcgtctgcgttcgctcaccccagtcacttacttatgtaagctcctggggattcactcgcttgtcgccttcctgcaactcgaattatttagagtatgacttttaactccaggagagaataaatgaaaaaagcactgcaagtcgcaatgttcagtctgtttaccgttattggctttaatgcccaggctaacgaacatcatcatgaaaccatgagcgaagcacaaccacaggttattagcgccactggcgtggtaaagggtatcgatctggaaagcaaaaaaatcaccatccatcacgatccgattgctgccgtgaactggccggagatgaccatgcgctttaccatcaccccgcagacgaaaatgagtgaaattaaaaccggcgacaaagtggcgtttaattttgtccagcagggcaacctttctttattacaggatattaaagtcagccagtaacccaggtttaatgagatgaaaaaaatcgcgcttattatcggcagcatgatcgcgggcggtattatttctgcggcaggttttacctgggttgcaaaggcggaaccgcctgcagaaaaaacgtcgaccgcagaacgtaaaatcttattctggtacgacccaatgtatcccaatacgcggttcgataaaccaggtaaatcgccgtttatggatatggatctggtgccgaaatatgccgatgaagagagttctgcgtctggtgtgcgcattgacccgactcagacgcagaatctgggggtgaaaacggctaccgtcacgcgcggaccgctgacttttgcccagagtttcccggcgaatgtcagttacaacgagtatcagtatgccattgtgcaggctcgcgctgccgggtttatcgacaaggtgtatccgcttaccgtgggcgataaagtacaaaagggcacaccgcttctcgacctgaccattcctgactgggtggaagcgcagagtgagtatttactgctgcgcgaaaccggcggtacggcgacccagactgaaggcattcttgagcggctgcgactggcgggaatgccggaggcggatattcgccgcctgatcgccacgcaaaaaatccagactcgctttacgctcaaagcgcccattgatggcgtgatcaccgcgtttgatctgcgcgcgggaatgaatatcgccaaagataacgtggtagcgaaaattcagggtatggacccggtgtgggtcactgctgcgatcccggagtctatcgcctggctggtgaaagatgcctcgcagtttaccctcaccgttccggcgcgaccggataaaacactcaccatccgcaaatggacgctgctacctggcgtggatgccgcgacccgcacgctgcagctgcgtctggaagtcgacaacgccgacgaggcgctaaaaccgggcatgaacgcctggttgcaactcaacaccgccagcgaaccgatgctgctcattccgtcacaagcgctgattgataccggcagcgaacagcgggtgattaccgttgatgccgacgggcgctttgtaccgaaacgcgttgctgttttccaggcatcgcaaggcgtcaccgcattacgctctggtctggcggaaggtgaaaaggtggtttccagcggcctgttcctgattgattccgaagccaatatttctggcgcactggagcggatgcgctctgaaagtgctacccatgcgcattgagggaataaccaatgattgaatggattattcgtcgctcggtggcgaaccgttttttggtgctgatgggcgcgttgtttctgagcatctggggcacctggaccatcattaatacgccagtggatgcgctgccggatctctccgatgtgcaggttattattaaaaccagctatcccggtcaggcaccacaaatcgttgaaaatcaggtgacttatccgctaaccaccaccatgttgtcggtgcctggcgcgaagactgtgcgcggtttctcacagtttggcgactcttatgtgtatgtcattttcgaagatggcaccgatccgtactgggcgcgttcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattacaggactggtttctcaaatatgagctgaaaaccatccctgacgttgcggaagtggcgtcggtgggcggtgtggtgaaagagtatcaggtggttatcgatccccagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgcgatgttgcgaaggtccagattggcccggagatgcgccggggcattgccgaactaaacggcgaaggcgaagtggcgggcggggtggtgatcctgcgatccggcaaaaacgcccgagaagtgatcgccgccgtgaaggacaaactggaaacgctgaaaagtagtctgccggaaggcgtggagatagttacaacatacgatcgcagccagctcattgaccgcgccatcgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcacttccagggactgaatgccaatattatgtcgttgggtggcattgcgattgccgtcggggcgatggtcgatgctgctatcgtcatgatcgagaatgcgcataaacggctggaagagtggcagcaccagcatcctgacgccacgctggataataaaacgcgctggcaggtgatcaccgatgcgtctgttgaagtggggccggcgctatttatcagtctgctgattatcacgttgtcgtttatcccgatcttcaccctggaagggcaggaagggcgtctgtttggcccgttggcgttcaccaaaacgtatgcgatggcgggtgcggcgctgctggcgatcgtagtgatcccgatcctgatgggctactggatccgtggcaaaattccgccggaaagcagtaacccgctcaatcgctttttgattcgtgtttatcatccgctgttgctgaaagtactgcactggccgaaaaccacgctgctggtggcggcgctttcggtgctgacggttctctggccgctcaataaagttggcggggaatttttaccgcagatcaatgaaggcgacttgttgtatatgccatcgacgctgccggggatttccgcagcagaggcggcgagtatgctgcaaaaaaccgacaagctaattatgagcgtacctgaagtggcgcgggtatttggcaaaaccgggaaagcggaaaccgccaccgattctgctccgctggagatggtagaaacgaccatccagcttaagccgcaggagcagtggcggccaggcatgacgatggacaaaatcattgaggaactggataacaccgtgcggctgccggggctggcgaatctgtgggtgccgccaattcgtaaccgtatcgatatgctctcaaccggcattaaaagccccatcggcattaaagtttccggcactgtgctggcggatatcgacgcgatggctgagcaaattgaagaagtagcgcgaacggtgccaggcgtagcttctgcgcttgccgagcggctggaaggtgggcgctatatcaacgttgagattaaccgtgaaaaagccgcacgttacggtatgacggtggcggatgtgcagttgtttgtgacttctgcggtgggcggggcgatggttggcgaaacggtggaagggattgcccgttatccaattaatctgcgttatccgcaaagctggcgcgatagtccgcaggcactgcgccagctgccgatcctgacgccgatgaagcagcaaatcaccctggcagacgtggccgacattaaagtctctaccggaccgtcgatgctgaaaaccgagaatgcgcgcccgacgagctggatttatatcgatgcccgcgatcgtgacatggtgtcggtggttcacgatttgcaaaaagcgatagctgaaaaagtgcagttaaaaccgggcaccagcgtggcattctccgggcagttcgagctactggagcgcgccaaccataagcttaaactcatggtgccgatgacgttgatgattatcttcgtgctgttgtatctggcgttccgtcgggtgggcgaagcgttgctgattatcagcagcgtaccgtttgcgctggtgggcggcatctggttgctgtggtggatgggctttcatctttccgtggcgacgggcactggctttatcgccctcgccggggtcgccgccgaatttggcgtggtgatgctgatgtatttacgtcacgccatagaggccgtgccgtcgttgaataatccacaaacattcagcgagcagaagctggatgaggcgttatatcacggcgcggtcctgcgcgtgcgcccgaaagcgatgacggtggcggtgattatcgccggtctgctgccgattctgtggggaacgggggctggttcagaggtgatgagccggattgccgcgccgatgattggcggcatgatcaccgcacctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataaggcattcacgctacatccgacaaaacgatgtcaaccatccgaaaccgctctcatccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttagtaaacgcgtagatctcgagcggtaaaccgttatcacctggagccagttggcgtaccattaaggtcatatctttacgaatccgcggatggttacgcagatattcgttcagataggcacgaaaggttccaatattggtcattcggcgcagatttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgcactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacatcagcacggcagccattgcaccaagaccgctgatcagaatcgctggcgactgaccaatcagcagcgagatcatcaaaatgccgaccagaatcgcgccgatcagtttaatcccctgaaatatccctttcagcggtaactgagatgctgccgggaatttctgcgccagattcaaaataacatccagcaacgagaagactgaaagcagcgcatacatcatgatccacaactgcgcgcaggtagtcagaatatctgccgcttcggtgcctttttgcagccagaataccgcctgaatattgacgataatcccctgcagggtaaaagctaaacggtggaagagtttattctgggtaatgatttgcaaccaaagccgtgaactggcgatggcacgtttttcgaaggtccgcagtaccacccaatgcaaaataatatgcaccacgacggcggtcagaaaaataataccgaaaatcatcaccatcgaggtggtgtgatcgatctcaatacccgctaaatcttcaacctgggatattaaatcctgcataacgtctcctttatacaacagcagcctatgatgacggctgaaacagggttatgcaaatcaggagaatctgagaggaaatagccgggcagatgcccggcaagagagaattacacttcggttaaggtgatgttttgcggcagacgagatttcggcagcgtagcgttaaaatcttcaacgctgtgatgacctaccggaacaaccaccagactggtgtagcctttctctttcagaccaaattctgcatcgaggatggcggcgtcaaaaccttcgatgggtaccgcgtccagacccagagccgccacgccgagcaggaagttaccgacgttgagataaacctgttttgccatccactctgcatcatcatgcagatctttacggtgcatatcagcgaagaacttgcgacctttatcgttcgcggctttcgcttccggcgtggcaaagcggccatcggcatcttcctggtcaacaaccagcttcagccagacatcgtccatcgcggtttttgcacagaacaccacgacgtgcgaggcatcaagcattttacgctcgttgaacacgtaattaccggcagcggatttggcaacacgcgctttaccttcttccgtgctggcaacaataaaatgccacggctgggagttggtgctggatgggctgtattgcagtagcgttttgatctgctcggcctgttccggggtaagttttttgctggcatcaaatgccttagtggaatgacgctttaaggcgacagaaatgatatccataaagactccatgtgaaagtaattttgcgtgccagcagattacaaggttcaacgagaaatggtaagcgagaaaaatgcgctatagatttccgctttagcctggacgcactcttttttgatcgcgtttagccagaccatcaaccaccagattccacgaatcgttgatcagatcgcgaagtaacgcttcggagatttcttcgccgggatacactgaaatccagtgctttttattcatgtgataccctggcttaatgcttgggtatatttgctgatttaacagggatttttgtggatcggacttcagattgataaaggggacgccgcgtagctccgacgacagcataaaaatcttgccgccaattttaaaaacatcgaactccgggccaaaaggccagcaaagctcgacaaagggtaactcaagggccaggcgtttcgccgtttcgtgcagtgattgcttatccataaacgttcctttaggcgaaggagaataagcaaagtatgccgcgaagtacggcgataatcgacgtttaatccgccagcgagaaccagcgtcgccagataaagcgcagaacaaaatactcaatagcgcccagcactaaaaaccacagacaaaacaataaagtgtaaagctgactaagatccatcagatggaacatggtcaccagtttttgtgccagcgccagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccggcttagtcaccggcccagatctcacaatgctttttcaccagcccaatcagcgagccgccatcggcgacgaaatcgcgcattagctgcgcttcattcagaccgctgacgacctggcgatgcagggcctcaatcgcgctcgatgcaccaattttatgtgcggaaggggcgattttttccagcaatcgcaaggtatcttccgttagcggtcgacgatctccagtgtgcggatcggtgatgacgccttcaagcccatagcgacaggcctggaaacggttgaatttatacagcaggtaatctttttcctgatgtttaaacgggcgttccgtcagtaaccagtgggcggtagcctgaattaatcccgccatatttactgcgtggctaagggttaacggggtatccatcacccgaacctccaccgtgccaaaatgaggactggggcgaatatcccagtgcagatctttaatgctgtcgatcatcgtggtgtaactcagacagcgaaacagggcttcaaattgttgccagttactgacccacggcatcgggccattatcaggaaaggcggaaaaaatattcggtcgtgaggaggcaaaacgcgtatccgttccctgcatatatggcgacgcggcggaaagggcgataaagtgcggcacaaatcgtgacaagccgtgcagcaaataaatggcgtcatcgccactggcgcagccaacatggacatgctgaccaaaaacggtcgcctgctgaatgagataaccaaagttttccagcgtgcgttgatagcgttcgttatcgcatacctcctgacgctgccatttctgaaacgggtgcgtgccaccgccgcaaatttccagatgatggtctgtggctgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgaagagtcctggcttaagtcatagcccggcggattaaccacctgcatttccagttcaataccgagggtaaaaggttcagaaacatgaaaatcgggtaatggcataggtttctcttatgttggcgttttctattcagtatagaagtcggagcggctgggcgagatgcggaagttctggaatgtttcttttttttggtgatggtgaactgatggtgcctgaagcaatttggctacttttgcaatgtgacaagttatggcagtgctgactggtggcgaagaattttgacgattgagtcatgcagaaaaaaacgggttcagcttcagttgattaaatgaggagtgagaagtccgaaacaggactcactgtataaataaacagctattttgttgaggaagggtaagataacggcgggtgcctgaagctttccggtttcaggtttactctgaggtctggaaagatgaagccccaggagatatttctatcaaccctggggctgccactccaaacccgaacaatttggatggtagtcccttcttcgcatggaggcaatataaacatgctgacgaaatatgcccttgcggcagtcatagtgctgtgtttaacggtgctgggatttacgcttctggtcggagactcgctgtgtgagtttacggtgaaggaacgtaatattgagtttaaggctgttctcgcttacgaaccgaagaagtagccgttgtgcggggagtaatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggagtaatccccgcatatccggttgtcaggtcaggatggtaaggcacctgctttacactttcgcccgtggtcagtgatggctgcgggcgaatcgtaccagatgttgtcaattaatcgtgttggcacagcgttatgactatcttttcttttatctgccagtgcacagcaaacatctcattctcacgatgaatgatgacctgctgtttattccagctaattatctgatagtccagaaaacctgcatcagtttggatctcacttgccttaaatgcgctctctttggcggaaaatgccagtgtcagcgccagagaaaaggctaaaccgcagtctgcgagtcgctcgtgttccgctggtgtaataatgttgtctgtcaattctcttgcggtttgtacagaaaaaatttcttctatatcaatgccaatcggttgacgagataccacggctaatgccgtagtcccacagtggctaatactgccgtatacctccgcaggccagacaggttggcgtagctcgccgattgcgggcacacatttatagccatattcccgcaaagcataaacagcagcgatccgtccggctaaatgctctgttttacgtttacgtccagcgtgttgcagttgtgcgtagtgcggcagccagagtaaatcctgctcacaaaaattcgccggatcgaactcaacaaaatgcagcgtatgtccggcaaaggggagggaggtatgcgtagttttcatatcgaccatattcgagactgatgacaaacgcaaaactgcctgatgcgctacgcttatcaggcctacatggtcctgcaatatattgaattggcaagatttttgtaggccggataaggcgttcacgccgcatccggcatgaacgacgcgcactttgtcaacaatctgacgttagcatcagaagtgggtgtttacgctcatataccacgtacgtcccggctcgttataggtatacgccccggcaccggcgatatagttggcccctgccaaatcgcccgtggtctgggcattacccgcacgccacaaacgtttgtcgaacagattgtccacgccgccggtcagactgacattcttcgtcacatcccaggtcgcgctcaggccaacaatgctgtaaggactaatttctttggtttccggtccaaccgctggctgacctttatagttgtacttcttcggctgctgcttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggcacgttatcccactgatagagatcggtgccgactgcgttttgccctacagccacatagcccgcttcaatcttattgcgataatcgttacggaaccaggtgacgcccgccagccacccgtcgcgtttgaactccagaccaatctctttgttgatgctggtttctgctttcaggtcatcgttaccttgcagatagcagccgcccgcgctggcatagcaaccctgacctttactgtagagaatgtagttcgggttagtctggtacaggctcggcgctttataagcacgggcgatgcccattttcagcgtgaagtcatcgcctaaaccttgcgatatgttcagcgccgggctccagttattgccgacaatactgtgatgatcgaaacgcagccccggcgttacgatggtgctgtcagtcagctccatgttgttttcggcaaacagcgagaaaatttctgcttttgaatacgggctacggtcggtggtactcacgccatcaatagcgccaccggtattcgttccggtcagtgcctgggtgttggaacttaagtccttcatccgttgctgattccactccgtacccagcgtcagcgtctggttaacgaggaaatcaatcggcaggttaacttcgctgtgcagcatcacgtcatcaagatcgatatcgacgaaatcctgtgtcgctttttcgttaaatttcccttcggtaccgcccgccagaccttccggaatacgcgagttacgggtgtgttcgtactgcacccagttgctggtggtcacgccgttatcccagccaccgttccaggtcagcgcgtagttctggcgatacagacggttggtttcatcgccatatttcgagcgggtataggaatcggagttggtattctgggtgtcgcccgcatacaggttaccctggcggctgtaacctgcttccagttccagcgattgcaatggcgcgaaatcccagcgcaccacgccattaatatctttgttgattaccccttcgcgcccggctggtaacgtcgtggcatacgttccggcacgcgcggactgatggccctggttgatatcccacgcgtcagcctgggttttgtcgaggttgccatacaaacggaagctgaattcgtcgcccagcggaccggtcaggctaaagttagtgcgtttggtggcaccttcctctttatgttctggcgcattgaaatatgcgtcccaggagccgtgccactcgccgctgccttttttggtaatgatgttaaccacgccgcccgccgcgccgttgccataacgcgcagctgccggaccacgcagaacttcaatacgttcaatcatttcaggtggcacccaggaagtatcaccacgggtatcgcgctcgccacgccagccctgacgcaccgagttacggctgcttaccggcttgccgtcaatcaaaatcagcgtgttttccggacccataccgcgaatatcaatctgtcggttattcccacgctgaccactggtggagttaccggtcaggttaacgcctggcatggtacggatgatcttcgacacatcgcgggcaaccgggtttttgcggatttcatctgcggtgatggtcgaaacgccaggcgcctgtaagttctgctcggcggcggtaacgacaatagtatcgtcatgtgaaacaggagtatcggtcggctcttgtgcctgcgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagttggttaattaatgtccgcgcttcccacggcgcgccattacgctattgcaaatgcaaatagttatcaataatattatcaatatatttctgcaatcaatgaaaaattgcacagtaaacatggggttatggtgtgacggcgttaaaagtaggaagtgagagctggtggcagtcgaaacatggcccggaatggcagcgtctgaatgacgaaatgtttgaggtcactttctggtggcgtgatccccaaggttctgaagaatactcgacgataaagcgcgtatgggtctacatcactggtgtgaccgatcaccatcagaacagccagccccagtcgatgcagcgaattgcaggcactaacgtctggcagtggacgacacaactcaatgccaactggcgcggcagctactgctttattcccaccgaacgcgatgacattttttctgtaccatcccccgatcgcctcgaattgcgcgaaggctggcgaaaactattaccccaggcgatagccgatccgctgaacctacaaagctggaaaggcgggcgagggcacgctgtttctgcactcgaaatgccgcaagcgcctctgcaaccgggatgggattgtccgcaagcgccagaaatacctgccaaagaaattatctggaaaagtgaacggttgaaaaagtcacggcgtgtatggatttttaccaccggcgatgcaacagcagaagaacgcccgctggcagttttgctcgatggcgaattttgggcgcaaagtatgcccgtctggccagtgctgacttcgctgacccatcgtcagcaacttcctcccgccgtgtatgtgttgatcgacgctatcgacaccacgcaccgcgcccacgaactgccgtgtaatgcggatttctggctcgcagtacagcaagagttattacccctggtgaaagctattgccccttttagcgatcgtgccgatcgcaccgtggttgccgggcagagttttggtgggctttccgcgctgtatgccggactgcactggcctgaacgctttggctgtgtattaagccagtcaggatcgtactggtggccgcatcggggcgggcagcaagagggcgtgttacttgaaaagctaaaagctggtgaagttagcgccgaaggtctgcgcattgtgctggaagcgggtattcgcgagccgatgatcatgcgggccaatcaggcgctgtatgcgcaattacaccccataaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccgcagggagcgttttacatattgcgcaatgcgcaggggcaattcagtctgtggccgcaacaatgcgtcttaccggcaggctgggacattgtgtgtcagccgcagtcacaggcgtcctgccagcagtggctggaagcccactggcgtactctgacaccgacgaattttacccagttgcaggaggcacaatgagccagcatttacctttggtcgccgcacagcccggcatctggatggcagaaaaactgtcagaattaccctccgcctggagcgtggcgcattacgttgagttaaccggagaggttgattcgccattactggcccgcgcggtggttgccggactagcgcaagcagatacgctgcggatgcgttttacggaagataacggcgaagtctggcagtgggtcgatgatgcgctgacgttcgaactgccagaaattatcgacctacgaaccaacattgatccgcacggtactgcgcaggcattaatgcaggcggatttgcaacaagatctgcgcgtcgatagcggtaaaccactggtctttcatcagctgatacaggtggcggataaccgctggtactggtatcagcgttatcaccatttgctggtcgatggctttagtttcccggccattacccgccagatcgccaatatttactgcacatggctgcgtggcgaaccaacgcctgcttcgccatttacgcctttcgctgatgtagtggaagagtaccagcaataccgcgaaagcgaagcctggcagcgtgatgcggcattctgggcagaacagcgtcgtcaactgccgccgcccgcgtcactttctccggcacctttaccggggcgcagcgcctcggcagatattctgcgcctgaaactggaatttaccgacggggaattccgccagctggctacgcaactttcaggtgtgcagcgtaccgatttagcccttgcgctggcagccttgtggctggggcgattgtgcaatcgtatggactacgccgccggatttatctttatgcgtcgactgggctcggcggcgctgacggctaccggacccgtgctcaacgttttgccgttgggtattcacattgcggcgcaagaaacgctgccggaactggcaacccgactggcagcacaactgaaaaaaatgcgtcgtcatcaacgttacgatgccgaacaaattgtccgtgacagcgggcgagcggcaggtgatgaaccgctgtttggtccggtactcaatatcaaggtatttgattaccaactggatattcctgatgttcaggcgcaaacccataccctggcaaccggtccggttaatgaccttgaactggccctgttcccggatgtacacggtgatttgagtattgagatcctcgccaataaacagcgttacgatgagccaacgttaatccagcatgctgaacgcctgaaaatgctgattgcccagttcgccgcggatccggcgctgttgtgcggcgatgtcgatattatgctgccaggtgagtatgcgcagctggcgcagctcaacgccactcaggttgagattccagaaaccacgcttagcgcgctggtggcagaacaagcggcaaaaacaccggatgctccggcgctggcagatgcgcgttacctgttcagctatcgggaaatgcgcgagcaggtggtggcgctggcgaatctgctgcgtgagcgcggcgttaaaccaggggacagcgtggcggtggcactaccgcgctcggtctttttgaccctggcactccatgcgatagttgaagctggagcggcctggctaccgctggataccggctatccggacgatcgcctgaaaatgatgctggaagatgcgcgtccgtcgctgttaattaccaccgacgatcaactgccgcgctttagcgatgttcccaatttaacaagcctttgctataacgccccgcttacaccgcagggcagtgcgccgctgcaactttcacaaccgcatcacacggcttatatcatctttacctctggctccaccggcaggccgaaaggggtaatggtcgggcagacggctatcgtcaaccgcctgctttggatgcaaaatcattatccgcttacaggcgaagatgtcgttgcccaaaaaacgccgtgcagttttgatgtctcggtgtgggagtttttctggccgtttatcgcaggggcaaaactggtgatggctgaaccggaagcgcaccgcgacccgctcgctatgcagcaattctttgccgaatatggcgtaacgaccacgcactttgtgccgtcgatgctggcggcatttgttgcctcgctgacgccgcaaaccgctcgccagagttgcgcgacgttgaaacaggttttctgtagtggtgaggccttaccggctgatttatgccgcgaatggcaacagttaactggcgcgccgttgcataatctatatggcccgacggaagcggcggtagatgtcagctggtatccggcttttggcgaggaactggcacaggtgcgcggcagcagtgtgccgattggttatccggtatggaatacgggtctgcgtattcttgatgcgatgatgcatccggtgccgccgggtgtggcgggtgatctctatctcactggcattcaactggcgcagggctatctcggacgccccgatctgaccgccagccgctttattgccgatccttttgccccaggtgaacggatgtaccgtaccggagacgttgcccgctggctggataacggcgcggtggagtacctcgggcgcagtgatgatcagctaaaaattcgcgggcagcgtatcgaactgggcgaaatcgatcgcgtgatgcaggcgctgccggatgtcgaacaagccgttacccacgcctgtgtgattaaccaggcggctgccaccggtggtgatgcgcgtcaattggtgggctatctggtgtcgcaatcgggcctgccgttggataccagcgcattgcaggcgcagcttcgtgaaacattgccaccacatatggtaccggtggttctgctgcaacttccacagttaccacttagcgccaacggcaagctggatcgcaaagccttaccgttgcctgaactgaaggcacaagcgccagggcgtgcgccgaaagcgggcagtgaaacgattatcgccgcggcattctcgtcgttgctggggtgtgacgtgcaggatgccgatgctgatttcttcgcgcttggcggtcattcgctactggcaatgaaactggcagcgcagttaagtcggcaggttgcccgccaggtgacgccggggcaagtgatggtcgcgtcaactgtcgccaaactggcaacgattattgatgctgaagaagacagcacccggcgtatgggattcgaaaccattctgccgttgcgtgaaggtaatggcccgacgctgttttgtttccatcctgcgtccggttttgcctggcagttcagcgtgctctcgcgttatctcgatccacaatggtcgattatcggcattcagtcaccgcgccccaatggccccatgcagacggcggcaaacctggatgaagtctgcgaagcgcatctggcaacgttacttgaacaacaaccgcatggcccttattacctgctggggtattcccttggcggtacgctggcgcagggtattgcggcgcgactgcgtgcccgtggcgaacaggtggcatttcttggcttgctggatacctggccgccagaaacgcaaaactggcaggaaaaagaagctaatggtctggacccggaagtgctggcggagattaaccgcgaacgcgaggccttcctggcagcacagcagggaagtacttcaacggagttgtttaccaccattgaaggcaactacgctgatgctgtgcgcctgctgacgactgctcatagcgtaccgtttgacggtaaagcgacgctgtttgttgctgaacgcacacttcaggaaggtatgagtcccgaacgcgcctggtcgccgtggatagcggagctggatatctatcgtcaggattgtgcgcatgtggatattatctctccagggacgtttgaaaaaattgggccgattattcgcgcaacgctaaacaggtaaattaatattatttataaacccataattacagaaaataattatgggttttttatttgtttgatttataggtttgatgaatatttctcttaaatagagtgaatgttgcattcagtggaaggaatttacaaacttcagcttcggataattatcaccaactggtaaagtgagcgccgtggagatttccccctattggactcattttcaggttataccccatgtcatcactgaatattaaacagggaagtgacgctcattttcccgattatcctctggcgtcgcccagtaataatgaaattgatttacttaatctaatctcagttttatggcgggccaaaaaaacggtcatggcggtcgtttttgcgtttgcctgcgcaggcttgctgatctctttcatcctgccgcaaaaatggaccagcgcggcggttgtcacgcctccagaacctgttcagtggcaagagttggagaaatcattcactaagcttcgtgtgctggatctggatatcaaaattgatcgtacagaagcatttaacctgtttatcaagaagtttcagtcggttagcttgctggaagagtacctgcgttcatcaccttatgtgatggaccaattaaaagaggcgaaaatcgacgaactggatttgcatcgcgcaattgtcgcattgagcgaaaaaatgaaagcggttgatgacaatgccagtaagaaaaaagatgaaccgtcactgtatacctcctggacgctaagttttaccgcgccaaccagtgaagaggcgcagaccgttttgagcgggtatatcgattatatctctacgttggtggtgaaagagtcgctagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtttacagtaatggtcaggccgttaaagatgaccccgatttttctatttctctcggtgcagacggtattgaacgcaaactggaaatagaaaaagcggtcactgacgttgcggaactgaacggtgaattacgtaatcggcagtatcttgtcgagcaattaacaaaagcacatgtcaacgatgtgaattttacgccgtttaaatatcagttaagcccgtcattgccagtgaaaaaagacggtccgggtaaggcgattattgtgatcctttccgcgttgatcggcgggatggtggcttgtggtggcgtgctgttgcgctatgcgatggcatccagaaaacaggatgccatgatggcagaccacttagtttaactatttgcggttgaaggtgccgttcgtccgagcggcaccacaagcggcgttccggcaactggatcgtcaatgatcatgcagcgcagaccataaatgcgctcaatcagttcagcagtgacaatctccttcggcgctccctgagcaacaattttcccttcccgcaatgcaatcaaatggctggcgtaacgacaggcctgattaagatcgtgcagcaccgccgccagggtatagcctttttcgcggttcagttcgcttaacaactccagcaaatcaatctgatgactgatatccagccaggtcgtgggttcgtcgagcagcataattgccgtttcctgggccagcaccatcgcgatccacgctcgctggcgttgtccgccagaaagggtatccacgctttgatctgccagatgagttattcccgtggcctgcattgctttcgttaccgcttcttcatcctctttgcgccagcgggtaaacagcggttgatgcggataacgtccacgcgccaccagctcctgcacggtgatatcgcccggcgtggtagcattttgcgccaacagaccaatccggcgtgcaacctctttactggcgtaatgttgaatgtgctcgccatccagccagacatgcccatgagcaggcgtcatcaggcggcttaaggtacgcagtaacgtggatttaccgcagccatttggcccgataattgccgtgaagtgaccatcaggtatttctacagtcagattttccgcaacggtatatttgccatatcccagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccgccagcagtaacagcgccccgcatagcgccgcctgggttagcccccagcgagcggtgccgctaatgcgtcgggcaatgtgcggtgcgactaaagcaataaaggaaatcggcccggcaagcgctgttgccgcagcggtaagcaccactgcaaccagcatcattaacagacgcgaacgttcgacgctgacgcccagcgcacacgcggtatcatcgcccatttccagcaagcgcatccggcgtaccagtaaggcggcggcaatgagcatcaatataatgatgggtgcggaaggcgaggtttttgcccacgtcaggccgttgagcgatccggcattccacaaacctgctgttagcgccgtttctaaagacgctttcagcaacagccaggtattaaaggccaccagcatggcgcgaacgccgataccgataataatcaaccgaaaggtgtcgatgccgttgcgccaggcgagcagccagaccagcagcgaagtgacaatgccgcccaccattgctgacagcgcgatagccgtcaggtcctgaccaaacagcaccatcgccaccagcacgccgctccacgccccggtgttaaagcccattacgtcagggctgccgagcgggttacgcatcagcgactgaaaaatcgcgccactgacgcccagtgctgcgccaatcaacagcgccatcagcacgcgtggtaaacgccattcggtgaccaccatcgtcatactgcgcggcgcatcgcccatcagcgcggcgaatacctgcgaggtttccagcgtgacggcaccgctgcgtaatccccagatacctgcaaccacacaggcggaaaccagcagcaaacaggtgatgagtaatcggcgagagacgtaaatcatgcaccacctcgcgttttacgtcgcacgaggaagatcagcaccggtgcaccaataaacgcactgaccacagaaacgcgcagttcgccgggcacaatcacccgcccgatgatatcggcaaacagcagcagggcaggggtagcaagtagcgtgacgggcagcgaccagcgatgatcggcacccaccagccaacgcgccatatgcggcatcatcaggccaataaaggcaatcgggccaactattgccgtcgcactaccacaaagcacggtaatcgccagcagaccaatcaactgtgtgcgcgccacgcgactgcccagcgccgtcgcggtgtcgctgccgaggctcaaactgttcagcgcgcgactcagtaatagcgcagttgctccggcgatcagcaccgggatcagcaccacttttaaggtatgtagattgcgaatatccagcgaaccggcttgccagaaacgcaactgatcgtagacgtcaggattaagcagggcgatgccgctggtcagtccttccagcaccgccgccagcgccacgcccgccagggttaaacgcaccggacttaactgcccgccgccctgactgccggtaaaggcaacaatcaatgaggccaccagcgccccggcgaaggccatcgccagttgttcctgcgcggaagagtaaccaaacagcgccgcacccagcacaatggcaaagctggctccggcgttcacgccaagcaagccggggtcggcaagtgggtttcgggtgagggtttgcattaacgccccggcaaggccaagcgcgccgcctgccagtaaaccggcaagggtacgcggcagccgcgcgtcgagcacgatggtgcagtcggcgctctggcaggtgccggagaaggcctccagcactacggaagcggggagtgattttgccccaatgagcaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaataggtatttaaaatatttgatggcaaggcattgtaatgaataaacaatcctggctgcttaacctcagcctgttgaaaacgcacccggcgtttcgcgcagtattcctcgctcgtttcatctcaattgtgtctctgggtttgctcggcgtcgcggtgccggtgcagatccagatgatgacacattccacctggcaggtggggctttcggtgacgctgaccggcggcgcgatgtttgttggcctgatggtcggcggtgtgctggcggatcgctatgagcgcaaaaaagtgattttgctggcgcgcggcacctgtggcattggcttcattggactgtgccttaatgcactgctgccggagccgtcattgctggcaatctatttacttggtttatgggatggttttttcgcatcgcttggcgttacggcgctattggcggcgacaccagcactggtagggcgtgaaaacttaatgcaggccggggcgatcaccatgttgaccgtgcgtctggggtcggtgatttcgcccatgattggcggtttattgctggcgaccggtggcgtagcctggaactacgggctggcggcggcgggcacgtttattaccttgctaccgttgttaagccttccggcgttgccaccgccaccgcagccgcgtgagcatccgttgaaatcattactggcaggatttcgttttctgcttgccagcccgctggtgggcgggattgcgctgctgggtggtttattgacgatggcgagcgcggtgcgggtactgtatccggcgctggctgacaactggcagatgtcagcggcacagattggttttctctacgcggcgatcccgctcggcgcggctattggtgcgttaaccagcgggaagctggcacatagtgcgcgaccagggttattgatgctgctctccacgctgggatcgttcctcgccattggtctgtttggcctgatgccgatgtggattttaggcgtggtttgtctggcgctgttcggctggttgagtgcggtcagctcgttgctgcaatacacaatgctgcaaacgcaaaccccggaagcgatgttagggcggattaacggtttgtggacggcgcagaacgtgacgggcgatgccataggcgcggcgctgctgggtggtttgggcgcgatgatgacaccggttgcttccgcaagcgcgagcggttttggtttgttgattatcggcgtgttgttattgctggtgctggtggagttgcgacattttcgccagacgccgccgcaggtgacagcgtccgacagttaatgcttaaaacagcgccttaagcctatccagcacttgcatggcgctgtagtaatccagacggaacgtctcggttcccagcgcataaacctgcttgttttgtactgcaggcaggtgcgcgagcagcggattagcataaatagcatcggcatctttctgatcaccggcgaacaggaatagtgactcgccatttaaccctgcagccagattttccccaccaagctgaatgatgtcatggcgtttaccctgactttggctggcatttaaccctgcgggtaacttcgccagcgtaaagccgagttgttccagcatctgcccttgtgctgattctggcgtccagagattggcactgtgtgcagcggcagtatagacaatggcagtgaccggctgcggcggtaatttgatttgctctttcgccgccgccagttgcttatcaaactgcgcaatccgctctgccgcttgtttctcatgcccggtaatttcgccaagttgcgttaacagcgactgccagcttttgtcgtcgtaattgatgattaatgtcggggcgatggtggaaagctgatcatacagtgccagcgccgaatccccgccggttgcgctaattaaaatcagatccggcatttgcgcggcaacggcttcggcgctcggttcgccgatatagagccgttgcagtttgcgttctttcgccaccttgctccactggcgtaaaaagccctggtcatccgcgacgcggttattcggcgtggtcgcgccgctggcgatcaccggagcatcaatcgccagcagtgagccggtcagggtgacgctggtggaaacaatacgctgcggctggctttccagtgtatgtgtgccacggctgtcagtaatctgacgcggccagtcagcggcctgaactgcggctattcctgaaagcaaaagtcctgttaatagaagggcgttgcggtagagcggggcgagtctcacaaatcagcttcctgttattaataaggttaagggcgtaatgacaaattcgacaaagcgcacaatccgtcccctcgcccctttggggagagggttagggtgaggggaacagccagcactggtgcgaacattaaccctcaccccagccctcaccctggaagggagagggggcagaacggcgcaggacatcacattgcgcttatgcgaatccatcaataatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgctgtttgccgatgccaaagcgcagggcatcaaaaatccggtgatggtcggggcgattcccttcgatccacgtcagccttcgtcgctgtatattcctgaatcctggcagtcgttctcccgtcaggaaaaacaagcttccgcacgccgtttcacccgcagccagtcgctgaatgtggtggaacgccaggcaattccggagcaaaccacgtttgaacagatggttgcccgcgccgccgcacttaccgccacgccgcaggtcgacaaagtggtgttgtcacggttgattgatatcaccactgacgccgccattgatagtggcgtattgctggaacggttgattgcgcaaaacccggttagttacaacttccatgttccgctggctgatggtggcgtcctgctgggggccagcccggaactgctgctacgtaaagacggcgagcgttttagctccattccgttagccggttccgcgcgtcgtcagccggatgaagtgctcgatcgcgaagcaggtaatcgtctgctggcgtcagaaaaagatcgccatgaacatgaactggtgactcaggcgatgaaagaggtactgcgcgaacgcagtagtgagttacacgttccttcttctccacagctgatcaccacgccgacgctgtggcatctcgcaactccctttgaaggtaaagcgaattcgcaagaaaacgcactgactctggcctgtctgctgcatccgacccccgcgctgagcggtttcccgcatcaggccgcgacccaggttattgctgaactggaaccgttcgaccgcgaactgtttggcggcattgtgggttggtgtgacagcgaaggtaacggcgaatgggtggtgaccatccgctgcgcgaagctgcgggaaaatcaggtgcgtctgtttgccggagcggggattgtgcctgcgtcgtcaccgttgggtgagtggcgcgaaacaggcgtcaaactttctaccatgttgaacgtttttggattgcattaaggagcgaggatgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctgaaggagagaacacgatggctattccaaaattacaggcttacgcactgccggagtctcacgatattccgcagaataaagttgactgggcctttgaaccgcaacgtgccgcgttgttaatccatgatatgcaggactattttgtcagcttctggggcgagaactgcccgatgatggagcaggtgatcgcgaatattgctgcgctgcgcgactactgcaaacagcacaatatcccggtttattacaccgcccagccgaaagagcagagcgatgaagatcgggcgctgttgaatgatatgtgggggccgggcctgacccgctcgccggaacagcaaaaggtggtggatcgcctgacgccagatgccgacgacacggtgctggtgaagtggcgctacagcgcgtttcatcgttctccgctggagcaaatgctgaaagagagtggacgtaaccagctgattattaccggggtatatgcccacattggctgtatgaccaccgcaaccgacgcatttatgcgcgatattaaaccgtttatggtggcggatgcgctggccgatttcagccgtgacgagcatttgatgtcgctgaaatatgtggccggacgttctggccgggtggtgatgactgaagaattactgccagcacctatccccgccagcaaagcggcgctgcgtgaggtgatcctgccgttgctggacgagtccgatgaaccgttcgatgacgacaacctgatcgactacggtctggattcggtgcgcatgatggcgctggcggcgcgctggcgcaaagtgcatggtgatatcgactttgtcatgctggcgaaaaacccgaccatcgacgcctggtggaagctactctcccgcgaggtgaaataatggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataagcatgatctggaaacgccatttaacgctcgacgaactgaacgccaccagcgataacacaatggtggcgcatctgggaattgtgtatacccgtctgggcgatgatgtgctggaagccgaaatgccggttgatacccgtactcatcagccgttcggtttactacatggcggcgcgtcggcggcgctggcggaaacgctgggatcgatggccggatttatgatgacccgcgacggacagtgtgtggtaggcacagaacttaatgcaacacaccatcgcccggtgtctgagggaaaggtacgcggcgtctgccagccgctgcatcttggtcggcaaaatcagagctgggaaatcgtcgttttcgatgaacaggggcggcgttgctgcacttgtcggctgggtacggcagttttgggatgaacccgacagaattagatgagattgcaggaaaactcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaagaaagtgctgttcggtcaccattttgcggccattgccggagcaggtccgctggtggggccggtactggcggcgcaaatgggctacctgccggggatgatctggctgctcgctggggtggttctcgccggtgcggtgcaggatttcatggtgctgtttgtttctacgcgccgtgacggtcgctcgctgggtgagctggtcaaagaagagatggggccaaccgccggggtgattgcgctggtggcctgctttatgatcatggtcattatccttgcagtgctggcgatgatcgtggtgaaagccctgactcatagcccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacctggatgctggtgggttacggttttgtggcggcggtgctgccggtgtggttactgctggccccgcgtgactacctctctaccttcctgaaaatcgggactatcgtcggtctggcggtaggcattttgattatgcgcccgacgctgaccatgcctgcgctgaccaaatttgtcgatggcactggcccggtatggaccggtaacctgttcccgttcctgtttatcaccatcgcctgtggcgcggtgtctggcttccatgcgctgatctcttctgggaccacgccgaagatgctggcgaacgaagggcaggcgtgctttatcggctacggtgggatgttaatggaatccttcgtggcgattatggcgctggtttccgcctgtatcatcgatccgggcgtgtattttgccatgaacagcccgatggcggtgctggctccggcagggacggcggatgtggtcgcttctgccgcgcaggtggtgagtagctggggctttagcattacaccagatacgctaaaccagattgccagcgaagtgggtgaacagtcgatcatttcccgtgcgggcggtgcgccgacgctggcggtggggatggcctacattctgcacggcgcgctgggcggcatgatggatgtggcgttctggtatcacttcgccattttgtttgaagcactgtttattctgacggcggtggatgcaggtacgcgtgctgcgcgctttatgttgcaggatctgctgggcgtggtgtctcctggcctgaagcggaccgattcactgcctgctaacctgctggcaacagcgctgtgcgtactggcgtggggctacttcctccatcagggcgtggtcgatccgctgggcggcattaacactctgtggccgctgtttggtattgccaaccagatgctggcagggatggcgctgatgctctgtgccgtggtgttgttcaagatgaaacgtcaacgttacgcctgggtggcgctggtaccaacggcctggctgctgatttgtaccctgaccgcaggctggcagaaagcgtttagcccggatgcgaaagtcggcttcctggccattgctaataagttccaggcaatgatcgacagcggcaatattccgtcgcagtatactgagtcacagctggcgcaactggtgttcaacaaccgtctggatgccgggttaaccatcttctttatggtggtcgtggtggttctggcactgttctcgattaagacggcacttgcggcattgaaagatccgaagccaacggcgaaagaaacgccgtatgaaccaatgccggaaaatgtcgaggagatcgtggcgcaggcaaaaggcgcacactaaagtcagagtgagggggggatgttggcgaatgttggcttagtgcccagggttccctctcaccctaaccctctccccggtggggcgaggggactgaccgagcgcgttgatagcatttgtaggccggataaggcgttcacgccgcatccggcactctttcagcaacatggttagcggaggccaagatgtttgattcactggcaaaagccggaaaatatttaggtcaggcggcgaagctgatgattggtatgcctgattacgacaactatgtcgaacatatgcgggttaaccatcccgatcaaacgccgatgacctacgaagagtttttccgtgagcggcaggacgcgcgctacggtggaaaaggcggcgcgcgctgctgctaaatttgtacgtcaggctttaaacgattccacttttttgaacgctgcacgcaacgtatctggtgtcagcgtgactggcaggtaatgaatggactccaccggacgcagggtgtgggcaatcactttgtcgatctccgcctgattattgatatccacttccagctccgccagtgtagtcggcagatgaaaacgctgatacgctccagttaattgcgccagcacatcatcctgacccagcaaggcgctttgcaccagaattccgtaggcgactttggtgccgtggagaaacttctcggtttgcggcagcacggtcagaccgttatgcacggcatgagctgccgccacacgcgtaaaacgatcgcccagaccaccaaccatcccaccaccagcaataatagcatccaccacatcgcaaaatgattgcgttaactgttgattttgctgatcgctcagcgcctgttcgctactgtttaacaagacgtcgcgaatggcttgcgcattattgatccccagtcgcacggttagcggcaacgtttctggttgcggagccagcaccaccgcttcataccatttcgccagcgtgtcaccgatccccgccagcagatattgttgcggtgcattgaggataatctccggttccaccagcaccataaaattggcgtcgtcgaaaatctcataatgcagcgcctgtccggcatcattataccagacggagagcggtgtccaggcggcgcaggtggcggcgatcgtcggaacggcaacaaacggcagaccgagacggcgggcgagggctttcgcggtgtcgagcagtgcaccgccaccgacgccaatcaccacgctgcggtcgtcaccggactcagccgccagttgttgtacatcgctttcgctgcaatgaccgcgaaacaaaatatgctttgcccctggcagtccaaacgctggcggaagtttggtttgcgccgcagcaatggcgcgtttgccgtagatccacaccgcgcgagaaagttgttcatcagtgaaaaaatcgtgcaggtgattgaaacttcctggatgtgaaaagtagttagccgggccgacgaccacgcggataggattgtgaggcatgttgtgttgtccttattgttttatttagacatctaaacgtcttgattgccaaatactagcatcgtgttatagtgccttcaacacgcaacttcgtcaggtacaataaaaatgacaaataaccctctgattccacaaagcaaacttccacaacttggcaccactattttcacccagatgagcgcgctggcgcagcaacaccaggcgattaacctgtcgcaaggctttcctgattttgatggtccgcgctatttacaggagcggctggcgcaccacgttgcacagggggcaaaccaatacgcgcccatgaccggcgtgcaggccttgcgcgaggcgattgctcagaaaacggaacgtttgtatggctatcaaccagatgccgatagcgatatcaccgtaacggcaggggcgacggaagcgttatacgcggcgattaccgcactggtgcgcaatggcgatgaagtgatttgttttgatcccagctatgacagttacgcccccgccatcgcgctttctgggggaatagtgaagcgtatggcactgcaaccaccgcattttcgcgttgactggcaggaatttgccgcattattaagcgagcgcaccagactggtgatcctcaacactccgcataaccccagtgcaactgtctggcagcaggctgatttcgccgctttgtggcaggcgatcgccgggcacgagatttttgtcattagcgatgaagtctacgagcacatcaacttttcacaacagggccatgccagtgtgctggcgcatccgcagctgcgtgagcgggcagtggcggtttcttcatttggcaagacctatcatatgaccggctggaaagtgggttattgtgttgcgccagcgcccatcagcgccgaaattcgcaaggtacatcagtatctgaccttttcggtgaataccccggcacagctggcgcttgctgatatgctacgtgcagaacctgagcattatcttgcgttaccggacttttatcgccagaagcgcgatattctggtgaatgctttaaatgaaagccggctggagattttaccgtgtgaaggtacatactttttgctggtggattacagcgcggtttctaccctggatgatgttgagttttgccagtggctgacgcaggagcacggcgtagcggcgattccgctgtcggtgttttgcgccgatcccttcccacataaactgattcgtctctgttttgccaagaaggaatcgacgttgctggcagcagctgaacgcctgcgccagctttagctatttaaccgtccaggcgcgggaatattgacggtcggcaaacaactcttgcaggccgttaatttgcttcaggcgcagcacttcgtcgctgtccattcccagctctttgccaattttattatcgtcccatcccaactggctaagttcacggacgatttccgacatggcggtgatttgatggcgtccacgagcgcgattatgacgaatagtcgcggcgatgcgttgattacgcgtaccttccagacaggtcaccggcaaataaccttttaagcgtaattttaatgatgatgagcctttaccaatttcatggcggtgaaaaccatccacgatttccatggcatttttatccgtatgtgtgaccacaatgggttgggtaaaaccatctatttcaatggatttttgcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgcgttaaatcctgcgttaatcgttgttgcatagtatcccccattcctgacgttttccttttatccgttcgttataacgctgatagttcttcgattttgtggggctaaatgataatgcccgacaccagtaatcgttattgagtaaaactttgcatatccgccgccaggaggggatatctttcgcgccaatgtccccttgctgggtttgtggaacctcgatgccttttttctgataccagtgcaaataaatggcgattttattgcggtaatgctcagctgttttttccggcatgctattgagcagcaataatgcatattcttgccagtctaaatgttctggcttgaggattttccgatgcccatagaaatgattgtcatgtccggcgtaaatgccgccactttttaccccgctgactcgtgcgcacatagcagcccagcgatccggttcgataacgtgatagagccataatccttgtcgttgctccgggccaaaaggttcgcaaattcgcatatgacgcagaggaacgcctgcctgatacattaggttatacagtgggttgcagagactttgatgatttgcataccaggtccagatatcagccactttccagtcgtaaatggggtaaatgtaccagctatgaccgcctggtgcggccgtagtccagggtttatcgtcggcaaaacgttgtttatttaaactggcgatggcgacaaaacggttgtaggactcatccgcacggatgccgatcatcatcgccgccggacgtttttgtgaaaaccattcggcaaactcacgtacaaattgttcgaaggtcatgcctggctggtaaaagcagaaaaagtcagggtcggttatcgcatcttggggaggttgacgtacccattcgacatcaggttcccagcactgccattcgggttggtattgtgaaagggaattttgcgtcgtaagcgggagcgcaacccagtaaaactcttcgatgacatcggtgtacaactcgcgcagggactgaacatagttaatggtgcaagagaattgcgcctcccagtcgataaacaaaacgcagatttttttgcccatttgtcgggcaagttcggctgtcagatgcagcattaaaccagagtctttgccgccagaaaatgagacacaaacgcggggtagggtgttgagtgtccaggtaatacgctctcgtgcagcttccagaatattgagcggaagaggaattttataaatagacatctgaagacgctctctgaacgttacagggtgatcagtgagataagtctgttaattataaagtaaacactgtaaagcagagtgttttatttttcattcgcgctgtgaataaatagatgaaagttatagtagctgtctgtagttatatatcaaaaactctcatttagacggtcaataaatcgggagaacaccaaattatttaaagaagatttattataggaaatgtaaagctttattgaaggtaacggatgttctagttttatctcttttaagttaagaaagtcacggtaggaattataaagttcataggggactattcccagtaaatctgtaactgcaatgctattaatgattgtcagcaaagaggaaccacgaaatgagattttgcgattcataaatctctcgtctatttccatttgaatatcatcaacccctgctgatttagatattaattgggtgaactcttctgccataatttgttcataagtgctattgtcagtaattcgtggatgcctattactacaaattagagtattgcgaatcgtatgcaatggcatgcaaatgacggaacggctgatcactggcatttgggtgatcaccagatcggctttgcggtgaaccaacagttcttcagcattctctgctgacatgaggatatcatggcactcaatctcgacagaggaatcttgccgtaggcagcggatcagcatactattattagagcaagaaatgagctgagggccgtagataataaagtttttctttagttcggacttattgactatattaattgtttgttcaaggcctctgagatttttctcaagatggtgatgcagatttaaccctgttgtcgtcggcgcgataccttttcctgagcgaatgaataaagggtcattaaattgcgcacgtaagcgttgtaacgactggctcacggctgatggggtgatatatagtgattcagcagctttgctaatgcttaaatgctggtaaatacactcaaatatgacaagaagatttaagtcgaactttttcaagtcgtagagattggccatacactactccggttatatttttcttccatgatatattcacttaatcaatgttttttgcgtatatatttttattgattatgtttttttgcttaactcaggattaagtttttctaaaatagcacagccacttagggcagagcgagcaattcatgcttttttaggatggttgaaaagcagggatatagttcaaccatccatgaattaccttttatttattccccataatgatattaagcgttttctgatcgggcaaccccacggcctgttgtagcgtattttccttactcatgtaatagatagccggcgtgacatttgcccccagatcgtccatcagtttctcattgtcacttaacactttcatttgctctgtacttacgtttgcaggcacgtttagcttaagcttgccaccagaggcttcatattgttgccaggtttttgcgggatctttggaggcaagaattgccgctgctgtcgccgggctttctggcttgataaccccaaccaacaatgttcttaattgcactttgccagaatctacccacgggcgcgcctgctgccagaactgtttacaatatgggcagaacggatcggcgaagacgtagacaatgaccggcgcatcttttttaccgtcgaggagccagtgggattgttccatccgttgccacatttcgcgtccggctggtgcgtaaatttctttttcgataagtgtgttactcaggttttcacctttctcgttgtacatgtaaccagagatagcgtgcttaccatctggagtcaggtagatggtgacgcccatatcctgatactttccgagataacctttcattcctccgggggcatcgaatgttttgatgattgtaatgccctgtttttcaatcgcttttactggagcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccactacgaagaactgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttccttcgtctttcacgccatagcggcgttggcgtcgcccgctcaccccggtcacttacttgtgtaagctcccggggattcacaggctagccgccttgctctgacgcgaaatacttcggaaattcacctaattcttcgggtgctgcggcacccgattttcttccccgcaccatgatgcaagctgcatccaggtagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccaggggccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagcgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggcgcggaaaaacgtgcggcagaagagctgaacaagcgtgatgcttatgacgtattaatcgtcggttccggcccggcgggtgcagcggcagcaatttactccgcacgtaaaggcatccgtaccggtctgatgggcgaacgttttggtggtcagatcctcgataccgttgatatcgaaaactacatttctgtaccgaagactgaagggcagaagctggcaggcgcactgaaagttcacgttgatgaatacgacgttgatgtgatcgacagccagagcgccagcaaactgatcccagcagcagttgaaggtggtctgcatcagattgaaacagcttctggcgcggtactgaaagcacgcagcattatcgtggcgaccggtgcaaaatggcgcaacatgaacgttccgggcgaagatcagtatcgcaccaaaggcgtgacctactgcccgcactgcgacggcccgctgtttaaaggtaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggcagcaaagtcgttggtctggaatatcgagatcgtgtcagcggcgatattcacaacatcgaactggccggtattttcgtccagattggtctgctgccgaacaccaactggctcgaaggcgcagtcgaacgtaaccgcatgggcgagattatcattgatgcgaaatgcgaaaccaacgtgaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgcaattgcttagccgccggggtcaaacctggcggcttttttatggcattaaaaagccccgccgggatggctccgggcagggcgggatacttattctggcaattaacgcacaaccagcaccggcagattggcgtggcggatcacgctcgaggcgttagaacctaacagatgggtcgaaatcgatgggttgcgagaaccaataactacaacatcagcccccagttcttctgccaactcattgacttcatcccgcacgctaccaaaacggacatgttgtttaatgcgggaaggatcgatggtgaagtggctgaccatcgtttgcagacgttcttgtgcttcatgttgcagatgctcttcaaaacgacgcacatcagcggcaaaacggtgcaggctcaggctggctgacccgggtagtacgtgaagtagatgaataactccgtcatcctgggcgaggaattcagcgtggcgaacagctttgtcgctcaattccatttcaaatacatcaactggcataatgattgtcttatacataaccctttctccctgttaatcatgaacaaatcattcgccatgattataatatttatccctgatatttgtctggttctttttccttacgaactgtttctgtgatgaatatattctcactgaacaccaggaattctcccaaaacctgtggtaccgcccgttttcccgctgtgatagctacccttaaagactgactcttttttgaactgtctctggaggttgcatgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccgcccggggatatgagattttcgaaaaacgtgaagaggagtgccgtaaggtgattctggtacccggtgcacaaagcgcagaggcggcgcagaaggcggtttcaggtctggtgaatgcgatgccggggggaacaatatgatcgtcaggagtggttttcgaggtaaaggacagccatgacgataatcgccgccataatcagaaatcctatcaggatgtaaaatgcttctgccatggttattcccacaaacgaaacggaataattttgcagcaaaagtgaacagtgagaaccaggaaaaattgctgattttgcgtaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctatcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtgctgcgagtgtcgcagataaacatacccaaaagaaaaccctcaccgtcaggcggcgagggtttaactcacatgatgatactgactgttgctcactctttgaagtgatttgcgtcacattcagggaattcctcaatgcagcgcattatgtataaatcttaatcgccttggtttatggaagacgaattagcgtgttttgtaaatcagatgattaataacccgctttatcaatcacaaaggttttgccacagttacctgggtgaggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatcgtaccgaagtatgcgtccggatcaaaaccaaagcaggcaccgtgtttggcatattcgtagcgttccaggcaggaacgtccgccagctcctggcatgacttcacttagtttagcggccgtttccagtgataatccggtttccggcgatgaacacattcggctggcgcgcgcttctggtagattcgggattgggcgagtagcgcaaccgaagcgcatccagcggcgttcatcaacaccacgggcagcaaccgatttaggcaatcctggccacagaccatgtacggtcagaaaatcagctttgttggtcgtttcggtttgcaggcgacattcatctcgttcgttacgatttcgatcgtgttgactctggcaaaatccggtttgccaggagagggccaggacatagcgatcaaaatcgccatactgttttgcctgcaacgctaaggcgttggcagaagagaagggaagcagagaaaccgcgagcaacgcggcgttacgccagaatgctttcataatgggtgtggaactcatacatacactgaatactatctattaaatcataaaaaagcccgccaggtgggcttacctggcgggcgtgatgatttattcagcgtttggcgaacgtattagttccacatggcgagaatcggccagccaaccaacagcaacatagagatgtaaatcaccccgaagattgcgccaagacgccagtaatcttttgatttcacatagccacagccgtaaataatcaccccaggaccggttgcatacggcgtcagacagcccatgataccgatagacagcaccagcaggatacacagttgttccattggtacgcccggaatacctttaccgacggccagaataaccggcagcatggttgcggtgtgcgcagacaggctggcaaacaggtagtgtgcaaagtagaacaccagaaccagtacaatcaccgttgcgtttggtgagaatccttccaggtgcgtactcatggtaccggcgaaccagtcaataaaaccagaacgagtcaggccgttagccatcacaaccagagttgccaggttgaccagtgtgttccatgcgctgttatagcgggtaatgtctttccaaggcacaacgtgcagggccagcattagcgaaactgccagcagaccaaccgcagtagcattaatgacttcactgccaaatacccacaaacctaagctgagcaatacaaggccaatcagtgtccactctctgcgtgtcagcgcacccatggttttcagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacaacggcggcaggtttttaatgaccggaaaaaccgtacccccggtacgcgcggtgttggaaggtgtaaacggtgccagcagaatgtcgataatgacaatcgcataacccaacgtcagcgtgcgtttgcccatgaatttcaccaggaaaagggcaatgcgacgacctaacccggaaacttcataccctaatgcaaaaataaatgcgccaaataccagccataccgtggtgctggaaaaaccagccaggccccatttcagcgcctgtttttgcgcattaaacgctgggtcagctaattctttggcatcaaagagcaggtaattactgccaataacgcaaatagtaaccgcaataaaactgatcgctgttgccggaattggctcgaggatcatgccgacaatcattgccacaaacacagcgaagtaatgccatgcctgcggcggcataccgtcggggacagggataagaaacatgacacccatcaccaccagtggggccaatagtttccatatattatcttttgctaaagacatacgggttctccgaaaattaatatttccaaatttatcaagtgcttaaataattaaatctgtgctaaaaaccaggtaaggatcagtaggtcagcactgccgcctggactgagatttcgttcgatacactccctgtcgaactgccggagataatcgagatcggcgggggttcgaatgccccctttttgcaataatgtttgcgcctcgcgctgtagccagcgcaggcccccctcgccaccgcgcgatgcaacgttggtatcgccgttgatcgccatcagtaggagcaaggtatcgagcaatgccagttcaggatctaacccctgatccagcagagtgaggtaatgcggcaaggcgtgattgatcaccagtggataacccgcttcggcttcaccgcgtgcgccggtaaggccaagctgttggtacaaccgttgacctgccgtcagttgtgaattattggtacgcagttcgcgatcggtcaggccacggcagaaacttgccgccgtagaacaaacggttgttggcgttaccggttggttgagttgaagcaaacggccaattgccgcacatagcagccctaaagaaaaaatgctgcctttatgcgtgtttacgcccgcagtggcgcggaacatatcaccttcgcaagccataccaattgggcgtaatccgtggagtaccgcttctggtgccatttccgcactacaggcaccaaattcaatgaaacggggtagccagccctgaatcgccagcgcgctgcggtggaaatcttccagcgccatatctttgtgcgcaccgcagttaatgcgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagtgcctccatgcggttgagtaaatcggtcagttgatgggtttttccacgcgcgcagacggctgcgctttgttcgcacaacaggcagcggcgaggcggcagtgaatagtcgcggcgggagagaatttcgccttcgggcgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgttttgcggctaaggcacgcaaggctgtcacgccatgattaaaaattcggcgtgtgacctcgctgtctttaatcggcccaggcgcaaccacggtaaaggagaccagtggaacaggatggcgcttgagccagacgtgttgccgtgcttgcctttcatcccggctgacgagcagctcgggaattgataccgcatggtggctggcgagttcaggaagcaggtgcatggcttattccttcacctgatgcacaacatcgatcaccgagccatcgcggtaacgcacaacggcaacgacgcggtctgtgaattcaatcggctgtggttcaccggtcagcagacgcgcacgttcgcgcagccactcaatggaaaccactttaatgcccgcttcctgcagacgttctgccagttccggacgtgccgggttaactgcgataccgtggtctgtgaccagaatatcgacactggagcctggggtgatgcaggtcagtacgttatccaccagagtcggaatacgaccgcgtaccagcggcgcgacgatgatggaaagcgcagaggcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgatgcgcctttcgaaccccagttagcgtactggttggcgctgatttcgatgtgattggggttacgggccagcgattgcgcagcatggctgtcaaagctctgcacatccagcagtttgcggatcagacctttttcgtgcaggtcaaccatcgtcgcggtaataccgccaagggcgaagtcggcgcgaatatcgcggctacgcattttgtcttccaggaaacgggttaccgccagcgatgcgccgccggtgccggtttgcatggagaaaccttctttgaagtagccagagttgacaatcacatccgcagcgctacgggcaataagcagttcgcgcgggttagtggtcatacgggtcgcgccagcgccgatttttgcagcatcgccaacgcggtcaactttgacgatcaaatcaacctgatcttgctcaatgcttgccggattatgcggataaggcagcagttcttcggtaagcatcacgacctgttttgcgttgtcggcatcaactattgcatagccgagggagccgcagcaggctttaccggtgtagccgttggcattaccgaattcatcacaggacgggacgccgaggaaagccacgtcgatattcagttcgccgctctgtaccagatgcacacgaccgccgtgagagtggatctgcaccggttctgccagcagaccacgggagatctcttccgccagtggaccacgcaggccggaggtataaatgcgggtaaccacgccctggcgaatgtgttctaccagcggcgcatggcaatcactcagggagctggacgccagggtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcagaaatccggcttcgttgttagcgtcggaatagacggtatcgaacgcctgaatacccgcagagcgcgcggcctgcaaaatggaacagcgtgcgaacagcagttcagttccttccggggagcgttctgtacgcaggttgcgcacatagtcttctgcaccgagggcgataccgatcaaacgctcggaagcgtgagcgatttccactgcgcgggtaatccccagcggagattcaatcgccgccagcaggccggtgctgccgggttcacgaccacaggctttttcgatacgcaggatctctttttcaatatccagaacatcctgagcggtatcggttttcggcagacgcacaacgtccgcaccaccgcgaacgacggcttccaggtcgttaacaccccattcggaatccagcgcgttgacacgcacaatggtttcaatatcgcgatacagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattggcaccaggcacaaacaacatgctgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctattgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccacgatgcacagtcaggcgtggaatatcggcggtgccttttaacaccaaatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctgtgccgctcataggcgaggtttatcaattcagtggctaatgtcagcgccagtccttcaccgcggacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaactgataaccttttattttcacttgggagaaagggggtgatcgaggtatatctttttctcctttcgctatacatcctaaggagtatttcggcgtgaaattttgatttatttcacatagagttagtggttttttatttatttaatgattttaagttttttaattaatgtaattacgaaatgactcgcaggtttaagtgatttaattgatttaatgaataaaatttgccacgatcataattaatatctatgtattttgattcaacattttaattacatccgtcaaagaggctcgggacaacccgcaaggaaaacaatgttgcagcttaacgagaataaacagtttgcatttttccaaagactggcatttccgctgcgtatctttttgctgattctggtgttctcaatatttgtcattgcagccctggcgcaatattttacggccagttttgaggactatttaacgcttcatgtacgcgacatggcaatgaatcaggcgaaaattattgcctccaatgacagtgtcatctctgcggtgaaaacgcgtgactacaaacggctggcgaccatcgctaacaaattacaaagagataccgattttgattatgtggtgattggggaccggcactcgatccgcctttaccatcctaatccggagaaaattggttatcctatgcagttcaccaaacagggcgcgctggagaaaggggagagctacttcattaccgggaaagggtcaatggggatggcgatgcgcgccaaaacgccaatctttgatgacgatggaaaagtcatcggcgtggtgtcgattggctacctggtgagtaaaatcgatagctggcgggctgagtttttattaccgatggcaggtgtgtttgtcgtgctgttagggattctgatgttgctgtcgtggttcctggccgcgcatatccgtcggcagatgatgggcatggagccaaagcaaatcgcacgcgtggtccgtcagcaagaggcgctgtttagttcggtttatgaagggctgattgcggtggatccgcatggttacattaccgccatcaatcgtaacgcaagaaagatgctggggctgagttcccccggacggcaatggttgggtaaacccattgttgaagtggtcaggcccgccgatttctttaccgaacagattgatgaaaaacgtcaggatgtggtggcgaactttaacggtctgagcgttattgccaaccgggaagctattcgttcaggtgatgatttgctgggggccattatcagctttcgtagtaaagacgaaatttccaccctcaatgcgcaactgacgcaaataaaacaatacgttgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgcgaggcgtttgccgatcgccaggtggcggggctgctttttggtaaagtgcagcgcgcccgggaactggggctaaaaatgatcattgtccccggtagccagctttcgcaactgccgccaggactggatagcaccgagtttgcagccattgtgggcaatttacttgataacgccttcgaagccagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggggtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaatctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggctggggcaaacgctaacccgtttccgccagcgtaaacatatgctggaaagtattgatagcgccagccagaagcaaattgatgagatgtttaatgcttatgctcgcggtgaacctaaggacgagctaccgaccggcattgaccccttgacgctaaacgcggtgcgaaaactgtttaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccacaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggtaccgaggtgcgttttacgacttcaaacggcgagatcttcgccatcccggcaaccgcaacgactacgccagaaacgggcgaaagggtacggccaaggtttgacgcctgcagcatcgggatagtcaaatacgccgggttaatgccggaagagtgcgccagtttcgggatcatctcaacaaacgcataaaacggcgcattgcctgaaccggtcgtgactgccgccagcattgtcagaatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaacgcatctgccatcccgcgataagccacttccagaccagagaaaactttctgggtattaaagctgcggaggaactccagaatggaggcaatcagcatacaaatcaccagaatagtgatgatgtgtaattgcggaccccatttaccgtcaaaaatcagtacaccgatgatcggcgtgaacggcaaaatggcataaaacgcaggagcagtggtggtgatttcactgacatctaacatttcatgagagatgtgctcttttttatccagataacgttgccagaagaagtgggcgatcgccatgccgataattgcagcaattgagataggcagcgtcgttttgaaggcgaagtcaatcagcgacatttcggaagcttgcgccgccagcaccacatcccctgaagtcggtgcgagaataatcgccgccggggaggcacaaatggcagcagctgcgccacgactgataccaacgtttaccatcaccggaaatagggttgccatcagcaaaacacccagaccggttgcggaagagacggccagagacatcagacaggcgacaaaataggcggcaatcatcagcaggtaaggggagttaatatactgcaatggttttgacgccagcttgaccaccatatcattcgcgccgatatgggtcatgtaagcggcaaatccacacagcatcataatcatcatgccgaggtcgccgccgcggctcattagtaatattttaacgtattcaacgatatccgtggcgctgtagcctgttgaagcctggctggacggtaacactttgtgccccataatggcactgataatcagcaataacaggccaccgacaaataacacaccagtggcggaataccctttaatgatgtagcgagctacacccacaataaccacaaccccaataaggagctcaatgaatgtcagcataatttttcctgtctccaggccccaaagtaaataataaaaaattcctaaagcttaaggaaaaaatatgcccaataaattggcgatgaatgctgattaaaatcaagaaaaactgccattaagacattgaagttgctgtttttatacatagataacaaaacgcatatttagcggttggcaattatcacataataatgtgtgcaaattgatggtggattgatgcaaatttgttaattgcaatggtgttagctgcggctgtgcgctcaaaaaataatctaatatgagcataggttgacgatatatattatatacttcgttaagatgattgttgtatctcgttaaaaaataaaataatttttccttgattgcattttgtcatcaaaaaagacttggtttttcttttttgactattcccatcgcagaaaacgacgcatcatctttaatcgatgcgcggaaatatttaacttgaacaagcggaaataaatagagcagctattcagattattctttatgttgggtctattaaggttatgttaattgtagctttgctatgctagtagtagatttttgataaatgttttatggtcacaaatgaacgtgagtaaatatgtcgctatcttttcctttgtttttattcagttaatcagcgttggtaaagtttttgctaacgcagatgagtggatgacaacgtttagagaaaatattgcacaaacctggcaacagcctgaacattatgatttatatattcctgccatcacctggcatgcacgtttcgcttacgacaaagaaaaaaccgatcgctataacgagcgaccgtggggtggcggttttggcctgtcgcgttgggatgaaaaaggaaactggcatggcctgtatgccatggcatttaaggactcgtggaacaaatgggaaccgattgccggatacggatgggaaagtacctggcgaccgctggcggatgaaaattttcatttaggtctgggattcaccgctggcgtaacggcacgcgataactggaattacatccctctcccggttctactgccattggcctccgtgggttatggcccagtgacttttcagatgacctacattccgggtacctacaacaatggcaatgtgtactttgcctggatgcgctttcagttttgagacaaatgaagttttagtaacttctttaaaatcaatagctaaaataagtaacatcaaaaataacgcgacttttatcactttttagtaaagttacactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtctttagtgtgcggttgaggccgaaaacagccagaatgccagtgcggtcatggcaaaagaccccagaaggttgacgaaaacgttcagtaatgcccagccaaagcggccctcttgtaacaaaaacaccacttctgccgaaaatgttgagaaggttgttagaccgccacaaaatccggtggtgattaatactttccacactggatcaatgttcgtcatcctgctgaaccatgcgaatcctattcctatgatgaatgccccaatcaggtttgctgtcagcgtccccaacggaatcgcctgatgcagtgggttaaatcgcatacttaacagccatctcgccacgcttcccgtaccaccgccaataaaaactgctaaaagaagttgtaacactgcaaaatcctgctatttgatttgtatgagtgataagtgtaacgccgaataatcgtcgttggcgaattttacgactctgacaggaggtggcaatgctggttgccgcaggacagtttgctgttacatctgtgtgggaaaagaacgctgagatttgtgcctcgttgatggcgcaggcggcggaaaacgacgcatcgctgtttgccctgccggaagcattgctggcgcgcgatgatcatgatgcagatctatcggttaaatcagcacagctgctggaaggcgaattcctcggactttacggcgagaaagtaaacgtaacatgatgacgacaattctgacgattcatgttccttcaacgccggggcgcgcatggaatatgctggtggcacttcaggcaggaaacatcgtcgcccgttatgccaaactgcatctctatgatgcatttgccattcaggaatcacgccgtgttgatgctggtaatgaaatcgctccgttactggaggtggaagggatgaaggtcggtctgatgacctgttatgacttacgctttccagagctggcgctggcacaggcattacagggagctgaaatcctggtacttcctgccgcctgggttcgcgggccgctcaaagagcatcactggtcaacgttgcttgccgctcgtgcgctggataccacctgttatatggtggcggcgggggagtgcgggaacaaaaatatcggtcaaagccggattatagatccctttggcgtcaccattgcggcagcgtcagaaatgcctgcactcattatggcggaagtgacgcccgaacgtgtgcgtcaggtgcgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttaacatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggcgttgcagtcagaatatccagagcacgatccatacgaccgcggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacatcacagaacggacaacggcgggtacaaatagcgccgaggatcataaacgttgctgtgccgtggttgaagcattccgccaggttagggcaggaggcttcctcgcagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctattactccgtgcaggatgggatcacgcaggctgaatttgttgtagtggatagagaaatctatttgctcctcatttaaggacggaaaaggcagtttttccagcggccagcagcggctaaacaggttataaaaacggctgggaataatcgctaacatgtcactgttggcaaccagtgcagcgattgtcaaaatgttgtagctggtgaaattgatttgccggtccggaaacatttcttgaactctctgccgcagaccgctgaaattttgctcttccggtaacagaagtacatgcgcagcgttgtcgatagtctctctgtcatcttctaaagagagtagtggatttccctcgcggcaaattaacaccatattgtcggtgaacagaacatgatgttgcaccgtacgattggtgcaaaacatgttatcgatgatgagatcggtttgaaactgactgagttggttttccgcgtcgctgatgggcgggttgcgcagtaaaagctgcggatagtgagttttaatcgcccgatagatgacaggaaggaccagtgctccgaccgagggagtggtcgcaatagttatcgttcgttgcttatcatagcttccttcgatatccagcgcgccaagaatggactcaaggccctgactgatatactcatgtagatgcatcgcaaatgcggtaggagtgacaccctggcctttgcgaataaacaatgggtcagggaatataacgcgcagtttctgaatagactgactgattgccgagggggtcagattaagcactttcgctgcattaacgatccctttatgtacatatacagcttcaaaaatagtcagaaggttaagatcaatatttcgtaaggttgtaaatatttgtggtttaccttctgacgactttctgcttaaacagggttcaatttgattattactatccacgcacttactccaattttattcatggaaaaataatatttaaaaaattacaataatcttatgtctaattggaacggaacgcttttgctcaccataatcaactatttcaataggttaatcaatggggtgagttacggagcaaggcgtggcaccgcatttctgcaagtgataaagaaaatatacaaacgcgaaggagatgtaaagcattagcagatattatgagtaatgacccagtgtaaattgggccattgatgtatggaattaagcggtaatatattcgaagtccggattgtttagtagcgctaaaatattttccagtaaacgtggagcaatattattagtcgtcgcttcgggtttccattgtgatattttagccatttccattccggcatacccacaaggattaatacgtaaaaatggtgaaagatccatattgacgtttaatgccagaccgtggaatgaacaaccgcgtcgaatacgtaaacccagtgagcaaattttcttttccccaacatagacacctggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcttttcctgcctgaccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcatctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgtttaatttttaaccaaaccagtgatggaacattaatttaatgtaatcaatgattttgccgaagaagttaccttccgggatttcttgcaacacaaccagcgggcgttgctcgatcgttttgccatcaagctggaagttgatagttccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcaaagaaacggaagccccaggttagcagttttttactttcggcttcacggcctttaaaagtacgtccgcccattaccgcagaaatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaatgcctggccgatcagcgccatatctcgcgcggagctgtactgaccatcagcatccagaccatgtaccgtctggaagtgggtatttttcaggcccagtgcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatctgcgttctgttcggcgagcactttgccggagttatagtcaatcaggatgtaggactccgcatcgatctgcggtacacccgggatcatagttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaagtgccctactatagcaaatgcactaccggcaggcatctgactttccgcgtgactttgttaacgtcatttacagaaattgacacatcagatgcctgctttacgctactgcgcggtagtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgcttacggccccgacttgcaccataaagttgccgctggcgctttgcgagacggcttgcggtgtcaccattgcaggcgaggttgcaggcgttgtcgacggagctgtaacaacgggctgtggcgcaggcgtcggttcgctgccttccagtacaccaggcgctaaggtcgttggtgcgccgaggaaaccgctactggttaccggcgcgccggtcggatcttcgctttttagcgtcgaattactgaccggaagaatgtcaccctgcgggccagacactgaacttgttcccgcgccaccgcttaaatcgggaggtgcaggcagggcgtaagtctgtttggcgactgtggtacaagccataccaggaccagaaagcgaaccatcctgggcaacaataatcggatcgatacgaactttggtgttgtttgacgtgttaagacggtcagctgccgcgcgagaaagtgaaataacgcggtcgttgccgtaagggccgcgatcattaatgcgcaccacgatcattcgcccgttagccaggttagtgattctggcgtagctggggatcggaagcgttggatgggctgccgtcagctgtgtcggatcgaatgcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtccgccccgctaatttcaactatagggccgttacataccgcaggctgcggtacacttaccgtctgttgctgaccatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtagagagcgagcagaatcagaatgcccactaatcccagctcttccgccagtaccgcgaagataaagtcagtatggcgttcggggagaaattcaagctgtgactgagtgccgtgcagccagcctttgccgcgtaatccgccggagccaatagcaattttagactgaataatgtgatagcccgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacagaccggaaagcgcaacgaggattgatgttcccaggtcaggctgtgcagccaccagcagcgtgggcataaatatcagcaccagcgcgatgccagtgttcttcaacgatggcgggcaaacgtcgcggttgataaagcgcgcaaccatcagtggtacggctattttggcaatttccgacggctgaaaacgaacaataccgaggtccagccagcgttgagcacctttagagatggcaccgaaagcatctaccgccaccagcaaaataatacagatgatatagagatagggggcccagccttcataaacgcgtggaggaatttgcgccatcaccaccatgatgaccagacccatcgcgatttggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagtgtaccaaccgccggacccgcaccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctagcaaagtatttatgcgccgtaccgttagggcggttagcaacaccgtacataccgtctttcgccagctcccagtaaccggaatgaatatcgccgacgggcggttcatgcggctgtacccatggcacctgtttgccgtcttcggcggtgctcatcagcaaatgaggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttacccatccattcggagaggcgatcgatccccatatcgtaggccacctgatagaagaaggtatccgcagattcttccagcgatcttgtgacattcagacgcccgtggccccattttttccagtcacgataacgtttttccgaacctggcagttgccaccagcctgggtcaaacagcgtcgtattgcgcgtgatcaccccggcgctcaatgccgaaaccgccacatagggtttaactgtagacgcgggaggataaaccccctgtgtggcgcggttcaccagcggtgtattcggatcgttcaacaaggcggaataatctttgctggagataccgtcaacaaacaagtttgggtcataactaggcgtggaaaccagcgccagcaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcgaataacacgcccacggttgttaacttcaacctcttcataaccggtctgaccgtgcagcacatcttcatagtaacgctcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcgacacccggaaaacggtactgattgacggcaaagcgagctacttgtacttcggtcaggttagttttcaccggaatagaggtgaaacggtgtgaacgtgcgcgctcttttcggaatgcagcaatatcgtcatcggtcagatctaccacgctgcgcaaagcgtccagcgtttgctgcacgttatcgactttctccggcatcatttctatctggtagatagtgcggttgagggccagagggataccgttacgatcgtagataatgccgcggctgggcgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcccttatcactcacggtgataaggatggttggtggtgatgctccacgcccggtacagactctctgcgaccagcacgcgaaccagcggatgggggagggtaagcgccgacagcgaccagctctgctcagccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtggtcagcaatggacataacatgacggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccgggtctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcgaaaatgccacatagcttcggcaggcatgccaattaaacgggcgattaacagactcagtacaccctgatggctgacgactaaaatattctgatagtgctgaaattcactaagccttgcgataaagcgttccacacgttgcgaaaatgcctgaaatccttcaccgttcgtggggattgcatgctgccagtcattgcaccacgcgctatagttttcggcatcttcttgcatgaggtcgcgatgatgtcgcatctcccagtcgccaaaaaacatttcgttgagttcaggtatgatttgcacggggagctggcggtcactgagaaccagtcgcgcggtatgctgtgcccgttccagttcactgcataaaaccagatcaaaggaaacaccatgtagcagcgtatgcagattttgcgcttgctcaataccgcgcgcggtcaggggggtgggcgcatgaccgctgtaaagaccatcgatattcgcttgcgtttcaccatgacgaattaaccacagtcgcatcatgccctccgtaacgacaggtatcagcgatacaagccttgttggttaatgtaagtcagtaccggttccggcaataaatcctcacatgattcaccgttttgcaaacgttcgcggatgatggtcgccgagatgttaaaccacggcgtttcagccagataaattttaccggcaggctgaaggtgaagatcttccgggttatgtgtcaaatgatcttccagccattgctggtattgcggttgcgccatttcaagtgggtaacctggacgccgacagacgatcaaatgtgcattgtcgagtatcgtttcgtattcgtaccaggtcggaaaggtcagcagtgaatcctgaccaataataaacgccagcggcacgtccggtccttgttcctgccgccactctttcagtgtttgcgcagtgtaagagggggcattgcgctttagctcgcgttcatcaagagtaaataatggcttgtcggcaatcgccagttcaagcatgtgtttacgctgcacgctgttcgcttccggctggggacgatgcggaggaacattattagggatgattgtgacccgcgtcagaccaatcaaattcgccagcgtttccacgggttttagatgaccatagtgcaccggatcaaaggtgccgccaaacagagcctgtaaagatttcatatcaaccgtcgataaatacgtccgccaggggtttatggcacaacagaagagataacccttccagctctgcccacactgactgaccgtaatcttgtttgagggtgagttccgttcgtgtcaggagttgcacggcctgacgtaactgcgtctgacttaagcgatttaacgcctcgcccatcatgccccggcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaatgcgcgcttactttttcccatcaacaaagcatcaacccaatgaaaaggggtgaaatgcgcggcatcattcaccgcctgttcaacgcgcggtaatgtcaatttgccgtctggccagagcagcgataaacgctccagtgcctgagccagcgccagcaggttaccttcataacagtagcagagcacctgatttgccgcgtcatccagttctaagttgagctgttttgcgcgcgcagcaacccagcggggaagctgagcctgctccggtgtctgacaggtcacctgcacgctgcgattcgcaagcgcagtaaaccaggcggcattttcttgcgctttgcttaatttattaccgcggacgatcaacagcaggtcgtcatgcagaagtccggtgagtgtgagaagttgctcattgatcgccgcattcggtccgttttctggtaacaacagcaatagcgtttgtcgactggcaaacagactcatagcctggcataacgaaaagatcgcattccagtcagtgttgggatcaatggaaaaagtgtggtgttcttcgaatccttgtgccgcagctacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattaaccgtcatgatcatctgatactctgctgtttgaccgttacggaataccgatgcggtatctttcgcgatgctcactttacccaaacgcaaggatggaacgtccttacgcgtggtttctttatcaagcaactcgacaccattcagacgtaactggttacgcaccgcacggcttaatggcccgttcggatcgcctgagtccaggatcatgaccttcatagtggaaggaacctgcgtggtatcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgattttggcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggacaacggccagcagtgcttcctgcatcagagcgcgatcctgctcgccatcggttggtgctttcgccagtttgttcatcagctccataatcgccgcaattgcggtgttgaaggtctgacgacggccgatatcatcggtcactttagcgatcgttttatgcacatcgcgacgcagcgctttctgattttcagtcagcgcatcaacgttcagtgccgcaacatcaccttttgctgtgtgctcgtaaaccagtttccagacacgtttcaggaagcggttagccccttccacaccggattcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcgccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcaataccaccaatgtagatatccaccggcagccagtagttagccgcttcggaatccagcataccttctttgtactgcgggcaagtgtagcgcgcatagtaccaggaggactccataaaggtgtcgaaagtgtcggtttcacgcagtgctggcataccgttaacggtagttttcgcccactccggatctgctttaatcgggctggtaatgccgtccattaccacatcttccggcaggatcaccggcagctggtcgtccggggtcggcattacggtaccgtcttccagcgtcaccatcggaatcggcgcgccccagtaacgctgacgggaaacaccccagtcgcgcaggcggtagttcactttacgctcgccaacgcccatcgcagtcagtttatcggcgatggcgttgaaggccgcttcatggtcaagaccgttgaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgccccggtaccgccataactgcgcccgtgccgtactccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggccgccagttcaggattattttccgccgctttctgcgccagcggatgacccgcagctaccgccaggtaggtacaacccataaaggtgtccgggcgggtagtgtaaacggtcagcgtgttgtcatagtcgttaacgttgaaggtgatctccacgccttcggaacgaccgatccagttacgctgcatggttttaacggtgtctggccagtgatccagtttatccagatcgttgagcagctcgtcagcgtaagcagtgattttgataaaccactgcgggatctctttacgttcaactttggtatcgcagcgccagcagcagccgtcgataacttgttcgttcgccagtacggtctggtcgttcgggcaccagttgaccgcagaagtcttcttatataccaggccttttttatacagctcggtgaagaatttctgttcccaacggtagtattccggcgtacaggttgccagctcgcggctccagtcataaccaaagcccagcattttgagctggtttttcatatacgcgatgttgtcgtacgtccacggtgccggagcggtgttgtttttcaccgccgcgccttccgcaggcagaccaaacgcgtcccagccgatcggctgcaggacgtttttgcccagcatacgctggtagcgggcgatcacgtcaccgatggtgtagttacgtacgtggcccatgtgtagtcgaccagaaggatagggaagcatagacaggcagtaatacttctctttgctctcgtcttcggttacttcaaatgtgcgcttctcatcccaatgaagctgtactttggattctatctcttccgggcggtattgctcttgcatggcagccagtggtcctgttttcaatacggctacaaatgtagcgttgaggtggtttttcagatccgcatagcatagcccaaacgtccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggttgcgtcactgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagaatctgacagcgtctttatgcgggtgattaaagaaagcttgtggcaggagctggcagacatcaccgataaaacgcagcttgaatggcgcgaagttttccaggacctcaatcatcatggggtttatcacagcggagaagtggtcgggctgggaaatctggtctgcgagaaatgtcacttccatctcccgatctacacaccggaagtgctgacgctatgcccgaaatgtggtcatgaccagttccagagacgcccgtttgagccgtaatagtctgatttcgcacagcaataaagagaatatgggccgaatgaaattccccggcccttgtttttatctctacagtaaatcttcagtctcacgaatttcctgactgacatctctggttccggatgactgaactttacgatacaggtcgagagcctgtcggagatcgacaggtcttccttctccgtagtgatacataatggccaggttataccaggcagtggcgtcattgcattcagcggctttcgtaaaccattcaaaggcagcctgataatctttctcaacgccttgtccgtgtttatacatataaccgatgttgacgtaagcgccgacgctcccctgagcggcagccttcagataccagtacatcgcttgcttatagtcctggtccaccccttcgccagcgttataatcccatgcaatttgaaactgggcgtgccgattaccctgctgtgcgcttttcaaataccagaatgcggcgagtgtcttgttttgagcaacgccttttccgtcttcataaagatcggccagattgttttgcgcgtcactatggccttgtaatgcagcttgtttgtaccagaaaaatgccagcgcatagtcttttgcgactccgttgccatttctgtacatccacccaagattattttgcgcataagacattccgctctccgcggctatctgataccagacaaccgcttctttataattgggggcttctccacgatccagtgtccagccaagggcgttggaagcgaaagtatggccttgtagggcagcttttttcagccagaagatggcttgctcattatctttatgacggcttttatcctcggtatacttttgccctaaggaatactgtgcttcacaatgaccttgctcagcggccagcttcagccagtaaaaggctttttcgtcgtccggagaatcaattgcgctatcgcgattataataaaacccaacaatatattgagcctcgcaatcgcctttttcagcacgttcgataatctcatctattgataaattatcgcagcaacttgacgtgaaaatcattatcatttccttatggttgcagataaaacatattatatttttatgtgttccatttttgcgtaagccttattttatgcgtattatgtcgcgtcagaaaagtataaataaacgagcctcgcaatgcggctaatattcatttaatgaatatttaaggataaattatatggacatggagtcgcaaaaaatattgtttgcactttccactccgatggaaatacgcaatgaatgctgtttaccttcgcattcatcacccaaaatgtatttaggtacatgcttttttgacctttcttcctcatggggaattgatgaccgtgatgacctgctgcgcacaattcaccgaatgatcgataacggtcatgccgctcggttggcagggttttatcaccgctggtttcgttattcgccatgtgaatggcgtgactatcttgctgaactaaatgagcaaggtcaggcttatgcgcaatttgtcgccagcaccgccgaatgctgtggcgaagggggaatcaaagcctgggattatgtccggatgggttttttaagccgaatgggcgtacttaataactggttgagcgaagaagaaagtctatggatccagtcgcgcattcatctacgggctctacgttattatagtaactggcggcaatactttgccggttatacctttggtcggcaatattggcagtctcccgaagatgatcatctgcctttattacgcgaattcttagcgcgtaaagaatacgacgattccggcaatgatatgttttatcaattatttgccagtgatgatgcgtattaccctaccttgtcctggcaaccattggcttactattctgcatgcccggaaacgcttaaggatatgagcgacctatgaaaaattgctggaagatcctcgatatagaggaaacgactgacgtcgatattatccgccgcgcttatctggcgctgttaccgtcctttcatccagaaaccgatccgcagggttttaaacaacttcgtcaggcgtatgaggaggcgctacggattgcgcagtcgcctgctaaatctgtttggcaaccagaagaatatgaggtagcagaacatgaaattctgctcgcctttcgtgcgttacttgcctctgatagtgaacgttttctgccctccgcctggcagcgattcattcagcaattaaattattgctcgatggaggagattgatgaattacgctggtcgctgtgcacaatcgccatgaacactgcccatttatccttcgagtgcgtggtgttattagcagaaagattgcggtggttacaggaggaaaataccggggaaatagacgaagaagaactggaatcctttttatatgccattgcgaaggggaatgtttttaacttccagaccattctgcatctgcccgttgccgtgcaaaatgacaccatcgatttttaccaaatgttcgctcggatttggtcatcgcatccacaatggctgacattgtatttagcgcaacatcgcgcagtgattatccccgatgatgcaaaactgcacagaaatttactccgctggtatagcgcaggtcgcctggatatccccgaacttctggattacgcccagtcatggcgggaaactgaacctgataatgaagatgcgccttattatgaatacgcgcaacgcgtctattgtggagaaggcgaaagcctgttggcagaactttgtgactactggcgcgagtatccctccacccaggcggatgctttaatgttgcaatggtgccgtcagcatcgggtcgattattacccattactggtgatgatgattgaagcgcgtgatctggttaacgatcagggaaaaccgctactttatgtccccggcgacagcgcccgtacgcgttttcatttatacgaaatactcagcgatgaaaaactctctgcgctggggcgttcactggtcgagatggttttgcacaaaggacgtaagccgcggatctcactcacgcgtgatacagaacataccttatggccattatatctagttgccaaacaattagtgcaggcctgccaacctacagaagaatcattaatgccgattgtgagccgccttgatgcagaaaatcgttgtccactggaagcattaattattcgtcgattattaattcaggcggcgaattttaccgagaagcaaactgttgaaccggagccgcaaccgcagccaatgcccgttgacgatggtgggccaggctgtctgggcatcattaaaattattttctatatttttatctttgctggtttgatagggaaaatactccatctgttcgggtgacagtcgacgttaatgtgcgggaagcccggcaagtaatctttccgcatttttgtaatgttgtttggcggtcagttttaaccatttttgagattcataatggttaacattaatacctgagccatttctgtagatcaaacctaaagtatattgagcatgagcatacccttgttcagctgcttccttataccagagaattgctttacgggtgtcgggtttgacccccagacctttgaggtagatccaccccagtttactttgcgcgcgtggattttcctgttccgctgattgctcataccagtatctcgcctgtgtataatccagtggtttaccgtcgctaccatgaagataaaattctccaaggcgatattgcgacgttgagtgaccatgaatcgcggaaagctccgtggctgccgtggtgaatggaagactgcccggtgagcttaaataatcaaaggcataattcaccatggctttatcacgcaacgtcgttttcttgggttggctaatacaggtaattgctgcaactataaaaattgcgaatatatacattaattttttattcatgtgtgaatgcttcgattttctttttattttgaaagcgtcaagtttatactcatcaataataaaaaagtagtcagttaatgcacttaagggattattaacaaatgaataaggaagaacaatatcttctttttgcgctttctgcgcccatggaaatacttaatcagggttgcaaacccgcgcatgactcgccaaaaatgtatactgggataaaagaattcgagctctcatcatcctggggaataaataatcgtgatgatttaattcagactatttatcagatgactgatgatggtcatgccaatgatttagctggcttatatctgacatggcatcgctcttcccctgaagagtggaaagcattaattgctggtggctcggagagagggttgatttatacccaattcgttgcccaaaccgctatgtgctgtggggaagggggaatcaaagcctgggattatgttcgaatggggtttctgtcacgggtcggtgtgctcaacaagtggctgacggaagaagagagtttatggctgcaatcgcgcgtctatgtacgagctcaccattactatcacagctggatgcactatttttccgcctattcgttaggacgtctctactggcaatcttctcagtgcgaagacaacacttcgctacgcgaggcgctaaccctgtacaaatacgatagcgccgggagtcgtatgttcgaagagctggcagcgggaagcgatcgtttctatgccacgcttccctggcagccattaactgtccagtctgaatgcccggtaacgcttaaggatgtgagcgacctatgaaaacatgttggcaaatcctcgaaattgaaagcacgacgcaaatagacattatccgccaggcttatcttgctcgcttaccgttgtgtcatcccgaaaccgatccgcaagggtttaaagcattacgccaggcctatgaagaggccctgcgactggcggtaaatcctgtcgaggaagcagatgatgaagaaaaagatgctgccgctgaacatgaaatactacgtgcattcaggacattactggattcagaaagtgatcgttttcagccttccgcctggcagaaatttattcagcaattaaatacctggaacatggaggatgtcgatcaattacgctggccgctgtgtgcaatcgccatagaagcgcgatatctttcattaaattgtgcttctttgctggcagagcgtttgaactggcattcatttaatgacagcgaaggaatggatgaggaagaaagggaggcttttcttgaggccattcaggctggtgattgtttcgatttccttagccttctggaatatcccattgcgttgcagaaccagactgttgagtattacttcgcgctggaacgttgctgccgttaccatcctgactatgtcactgcgtttttggcgatggaaggtccgtggttaattcctgatgatgcaaagttacatcgcaaactgttgcgctggtacagctcggtgcaaacaggtatggcggaactcattcctgtcgctcaacagtggcaaacggaagaaccagaaagcgaagatgcccggtattacttgtgtgcacaacgtttgtactgcggcgagggggaaagcctgcttgccgatctctgcgcgtactgggaaagttacccatctacacaagctgataatttgttgttgcagtggagcaagcgtcattgcccggattatttcgcgttattagtgatggttatcgaagcgcggagcatggtagatgcgcaaggtcaaccgctgaaatatgttcctggtgagagcgcccggacgcggctgttatgggcggagattttacatagcggaaaattatcgccgttaggtcaatcgtttattgagtcgttattcttcaagcgcaaagcatgggcgtggtggaaatcgagagtcggtagcgagacagagcaagattcaccgttcctggatttgtatcgggtagcggaacaggtagtacttgaagcgtttccgaaacaagagatgctggcccgtcttaatacaaggctggaaggcggagatgctcatccattagaggccattgtcacccggatgcttttgacgaaagtgaaactcgagccggaggatgaagatgtcgatgagccaacacctgaaaatcatgaagaaaaaaatgatgagggtgaaaaaccacagagcattaccagcattatcaaaatcagtttaacggtgctggtgataggttatgctctcggcaaaatcgcgatgttgtttagctgacgatgtgttttttgcgccgatgccggatgcagcgtttacgccgcatccggcagccgtgtttatgggatctcaatggctaaataatcgctcgcccgccgccgaacttcatccacgcgggccatatcgtttgactgcaacgccgcatcaaaatcggtgatcacccggccgatctcttctcgctcgtcacccagcgcccgcgcccacaactcttccagtttggctttaaaggtgcgattgatgagcatatcgcgcggataaattttcaatgcggataaccgcgtccgactctcttcaatctgctgcgcgctcaatgttaccgggctgtggttaatcactctggacttaacgctgccgtcttccagaagcacgtcaacttcaagcaacccgttgatatcataactaaagcgaatatcaatcgactgataagccccggttttcttcaacggcacatcgaaggattccaccagaatgttgtttttaactttgtggttttctccctgatagacgttaaccgtaattgaatcctgttccgggtgcatggttgaataagtttctacacgcgacacgggcacagtggtgtttcgttcaataatcggcgagaaaatgccggaaacgccctggcggttaacttcaacgcccaacgagtaagggcaaatatcagtgaggattacctcttcaatatcttcactgcgtaagcggcaggcggcctggattgctgcgcccagcgcgacaatggtgctcggatcgtaactttgatacggtaatttgccaaacagacgcacggcgattcgctgcaccagcggcatttgtgacgcgccgccaaccagcaccagactgtcgatttgactcggcttcagacgcgcatcgcgcaacgcctgttcaatcggcactcgcaagcgattgagcagcggcaaccacaaatcttccagttcgttctcgtaaaattcgcattcccgcgtttcttcctgatactgccagcgaatgtgcaatggcgattgattgctacattttgccgcttccacacaggcgtacaaggctgccagttcactctcgttaagcgtggtcctggcgacatccgcgcgttttaaaacctcatcgaccagcatatgggtaaaatcttcgccaccaagaaagttgtcgccagcggaggcgtgaacttcaatcaccggcgtggcgtactcaagcaccgtaacgtcaaacgtgccgccaccgagatcaaacaccagcgaacgggtattttgttgggtatgcaggccatacgccatcgcagctgctgtgggttcattaattaagcgtaccgcatttaacccggctaactccgctgctaaacgggtatgcttgcgttgttcatcgctgaaataagccggaacggagatcaccacatctttaatcggacgttgcagaaattcttcggcatcttcttttaatgagcgtaataccaaagaggacagttctggcgcgttaaatgtgtcgctgcctaaccgccagttggtattactgcccattgcacgtttaaataacgctgccgttttatccggatgcgaagtacgccgtgatacagccggttttccgactaaaatatgattattttcatccatgctaattatggatggtgttaaatattcaccgaacttatttggaattaattgcgcggcaccgtctttccagacggcaattaaactattggtagtaccgagatcgataccaatggcgagttctgcattatccattgcatttatatcttgaaagaaaaagagataaacagattaagaccacccaggtaacgcgtggtgatcttaatcaatgacgtgtgttaagcgtaaaatttcagacgatcagccagtaaatcaacaaagccctgacgatcaacatcgaccattacggtggcattcggtttattgcctgtcagataataataatcaacaaccgtcataccctgggtatatttcccctgtgtttccacgccaacccagcgctcaacagaggtaaataactccggtttcaacagccaggcgatggtgcatgggtcatgcagtggtgcgccgacaaagccccatttttcgtctttatgatattcgaggaagaaatccagcagttcggcaacaatggttgaaacagggttaccaatcgcgcggaaacgctcggtgtcttcaacgtggatttgtgctttatgagtaacatccagaccggccatcaccaccgggatccctgactggaagacaatttctgccgcttccgggtcaacgtaaatattaaattcagccgcaggcgtccagttacccagccccatagcgccacccataatcacgatacgggcaattttgctatgcagttccggatggctattgagcagcaaggcaacgttagtttgcggtccggtagacacaatggtgacaggttccgcactttcacgcagcgttttcgccatcagctctaccgccgtacagttttgcggtgcgaatgtcggttccggtaatgccgggccgtcgagaccgctttcgccgtgcacattgtccgcgataatcaactcacgcattaacggttttaccgcgccgcctgctaccggaatatcggtgcgattaagcaaggtcagcatacgcagaacattgcgtaaggttttttctggtgtctggtttccggcggaagacgtaattgctttgacatcaagctctggtgaggcgagggcgagaactattgcgatagcgtcgtcatgacctgggtcgcaatctaacagaattggcagtgccattgttgctccttgttgtgtgcttctttgcgacaagggtaacgccaggatgtaacagatacgaggggcgaaacgataaagcgtgagatggcgcgcaattgggtatgcgcgccagagtgattaatgcaggattttcgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatggtcattccttcgttcgccagttccaccatcacgtccagtacttcgttgatcatctccggatccagcgccgatgtcggttcgtcaaacagcatcgcaataggatccatacacaacgcgcgagcgattgccacacgctgctgctgaccgccggaaagctgcgccggaaacttattggcgtgagcagaaagcccgacacgctccagcagtttcagggctttttcacgagccggcgctttatcgcgtttaagcactttcacctgcgccagggtcaggttttcgataatcgacagatgagggaacagctcgaaatgctggaataccatcccgacgcgggaacgcagctttgccagatcggttttcttgtcgttaaccacgataccatcgacggtgatttcaccttgctgcaccggttcgaggccgttgacggttttaatcagcgttgatttgccggaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaagactaataacgaaataaacaaatccggcaaacaggatcatctcaacctgcgtaccatcacgctcaccaatggttgaggcggtacggaagaaatcggccagggataacacatacaccagtgaggtatcctggaacagtacgatgccctgagtgagcagcagcggcaccatcgcgcggaacgcctgcggcagaataatcagtttcatcgactgccagtgagtcattcccaacgccagcgcggcgctcgattgaccacgagaaatactttgaataccagcacggataatctctgaatagtaggccgcttcaaacatcgaaaacgccaccatcgccgaaattaaacggatatcattttttggcgataatcccagcacgttttgcagaaaacccggcacgatcaggtaaaaccacagcaaaaccataactaaaggaatcgagcggaatacgttaacgtaggctttggcaaaccacgccacgggcgcaaagctggataaacgcatcaccgccagcatcgtgccccacaaaataccaatcactaccgccgtgacggtgattttcagggtgatcaccagcccgtcgagcagatatggcagggaagggacaatggaactccagtcaaactcgtacattatttgccccccatgttgccaggcaggcgaactttacgttcaaccagcgtcatcaccagcatgataaaagcgttaatcaacacatacgccagcgtaatggcggtaaacgactcccaggcatgggctgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtatcgataagcctgcggtagcgtcaggcccatcgccagcgcggcatttttttgccctcgcggcagcgactgaatcgcggcgcgtacctgttcgcaaacacgggcggcggtaaacagccccaggcagagcatggatgaaaggaaaaactgaatattgggatccagctcggccttaaaccacatgccgattttctccggcagcagctccgggatcaccagataccaggtaaagaattgcacaatcaacggcacgttgcggaacagttcgacatacaacgtacccagaccagagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccatcaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattggatttttgaaccacttatcaaaccatttttccgcttcaccggaggtctgcacctgagcgatggtgtcatccatcagctttttgaactgcggatcatctttacgcaacatacaaccgtaggcctcctgagactgcggcttgccgacgatttcccagttgtctggtttcttcgctttcgcacgttcaccggccagcagagcgtcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgactacggctttgtctttcaggttggcaaaatctttgatatcgccaccctttttggtcaacaggcgcgtaccgaccacgaaaatagtgtcagagaaagccgcctgtttttggcgttcgacgttgttggtggtagaaccacattcaaaatcgaaagtgccgttttgcagcagtggaatacggttttgtgaggtaatcggaatcagttttacctgcaagtccggtttgttgagtttctttttcactgcttcaacaatggcgttggagtaatcctgcgagtaacccaccactttttgctgattgtcgtaataagagaaaggcactgaagattcacggtgaccgacgacaatcacaccgtttttggcgattttgtccagagtactgcccgctgccggggcggcgtcatctgcctgtgccagtcctgcggaaagcgccagggcgaggattgctgtggcaggtttacgtaattgcatatccaactcctttatcttctgcgttaagaacgcatggatacccgttgtgagtgtttgtgttgttatcgtctgcaactttattgtgcagtgttgtgcctgttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtaacatttagtttggctaaatgtaaagatattgctgttttattgtttgtttttgcgagatgcgccgcaccattccgaagcaaaattcttaaaatgcactcttttagtgctaccgctggattactgtggtgcaactaggttgtactgatgctgtttcagggtttgccttgtataacaaagcaatagatgtgccaaagttggataggagaatattgttatccggataatgcactgatgccgcatccggtgagcgtgccgaaatatgggatgtattccggcacgataagaagggattatttacgtcgctgacgcagactcatcaacacagcagcaaaaccaaacaatgccgtcagcacccacagcggccagttgccggtacgtgcgtatggtgtgagtccggtggtcggcgtcacgttagtggttaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgttgccatggaccaatagatttaccaaaccacgcatcgttggagatagtcagcagatagtcggtatccgggcggaagttatcgcgcacttgctcgccgagaatgatctcgtagcaaatagccgcagtaagctcaataccatttgccgacagcggcggctggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggcgcacctttacccagcgtgatgatggtgttgtaggtatcgtagcggttctgcttattgagacgcgcgtcgacaatcccggttaccagcgagctacctttatcacgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgcggaatatcgccctgaaccatcgaaacctgaatggttttctccggttgtggggtaaaccactggatgtaacgcagcgggaagggaagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcggcaatcgctacgcgcagccaggtggttttcggccacagacgcgacagcacgccagcaaacagtccggtatacagcgacaaatacgccgccagcagcaccaccaggaagatgttaaccgggccaggcattccgccaaaggtcgcgatgctgacatagacccagttaataccgctgccaaagaggccaaatccccagcaaaagccaatagcggcagactggagtggacggcggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatagtttcgccacgcgccggaagatgcccaaatgcctgcatcaccagaccaccgatagtgtcgacttcttcatcgctaaagtgggtgccgaacgcttcgttgaagtcttcaatggaagccagtgcgcgtacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaataacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaagacattcgtccagcgtctggttgcgtttcagggtaatcatctgggagcgggggatcatgatgtcgcgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcatcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggcacttcaaacgggaaggagagcacgttggtcggcttatccttaccgcgataggtcagattcagactgtggctttcggcggtatcgaccacgcgaatcgtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgcttttcgtttttgttcggcttcttcccaggcttcataggcgttaacgatacgcgccaccacagggtgacgaaccacgtcttcgctgtggaagaagttaaagctgatctcttcgacatcggccagcacttcgatggcgtgacgtaagcctgatttagtattacgcggcaggtcgatctgtgtgacgtcgccggtgataaccgcttttgagttaaaaccgatacgggtcaggaacatcttcatctgttcgatggtggtgttctggctctcatcgagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttctactgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgaccgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgcagcggtgacgcaaatcggacggccggtcagtttaaagtggttatcgcggcgattgatctcgatgccgagacggcgttcgagctgcttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcaataaagatggggataaagagagaaaaaacaaggcccaccggaacggcaggcctgagaattacggctgataataacccacgccaaggtcgttttctttgcgggtacgggcaatcactgattccggtgtttctgccacgcgcagacccatttcatcttcagtacgcaccactttaccgcgcagagagttcgggtagacgtcggtaatttctacatcgacgaatttaccgatcatatccggcgtgccttcgaagttgaccacgcggttattttccgtacgcccggaaagctccatgatgctcttacgcgatgtaccttctaccagaatacgctgggtggtgccgagcatccggcggctccacgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcttcggtggtttcgccagggaagccaacgatgaaatcagaactgatctgaatatctggacgcgccgcacgcagtttacggatgatcgctttgtactccagcgccgtatgggtacggcccatcaggttcagaatgcgatcggaaccgctctgtaccggcagatgcaggaagctcaccagctccggcgtgtcgcgatacacttcgatgatatcgtcggtgaattcgatcggatggctggtggtaaagcgaatacgatcgatcccgtcgatcgcagcaaccagacgcagcagatcggcaaacgatccggtggtgccgtcgtagttttcaccacgccaggcgttcacgttctgaccgagcaggttgacttcacgcacgccctgagccgcaagctgggcaatctcaaacagaatatcgtcggacggacggcttacctcttcaccacgggtgtaaggcaccacgcagtaggtgcaatatttattgcagccttccatgatggagacaaacgcggtcggcccttcggcgcgcggttccggtagacggtcaaacttctcgatttccgggaagctgatatctacaaccgggctgcggtcgccacgcacggagttgatcatctccggcagacggtgcagcgtttgcggcccaaaaataatatcgacatagtgggcgcgctggcgaatgtgctcgccttcttgcgatgccacgcagccaccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttaggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaaccagcgccgtttgtcgctgatagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtggtgtttgacgccgctgaacttaagctaccgctgcttggctatatggtggaaaacactgtcctgcaacaggcgttgtggcaggcgctggaagcgcatccgaaagtaacgttacgtgtgccaggctcgctgattgcgctgcatcgccatgatgatcttcaggagctggagctgaaaggcggtgaagtgattcgcgcgaagctggtgattggtgccgacggcgcaaattcgcaggtgcggcagatggcgggaattggcgttcatgcatggcagtatgcgcagtcgtgcatgttgattagcgtccagtgcgagaacgatcccggcgacagcacctggcagcaatttactccggacggaccgcgtgcgtttctgccgttgtttgataactgggcatcgctggtgtggtatgactctccggcgcgtattcgccagttgcagaatatgaatatggcacagctccaggcggaaatcgcgaagcatttcccgtcgcgtctgggttacgttacaccgcttgccgctggtgcgtttccgctgacgcgtcgccatgcgttgcagtacgtgcagccagggcttgcgctggtgggcgatgccgcgcataccatccatccgctggcggggcagggagtgaatcttggttatcgtgatgtcgatgccctgattgatgttctggtcaacgcccgcagctacggcgaagcgtgggccagttatcctgtcctcaagcgttaccagatgcggcgcatggcggataacttcattatgcaaagcggtatggatctgttttatgccggattcagcaataatctgccaccactgcgttttatgcgtaatctcgggttaatggcggcggagcgtgctggcgtgttgaaacgtcaggcgctgaaatatgcgttagggttgtagccttacaacattgccggatgcgtgccaaccgtaggtcggataagacgcggcagcgtcgcatccgacattgaaggataagacgtgtcaacatcgcattcgacattgaatgaacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggttttgaatttgccgaacatattcgatacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaagatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaagatggtggctacgacgggattcgaacctgtgaccccatcattatgagtgatgtgctctaaccaactgagctacgtagccatcttttttttcgcgataccttatcggcgttgcggggcgcattatgcgtatagagccttgcagcgtcaacctctttttcaaggaaaattgctcgaaagtgactgtttggttaggttgcgaacagcgtggcgctatattcgtcaattattgtttactttgtgttttttcccaccctacagccattcttttgtcatacaggatgaaattcggaatttaacaatagtggtgggaaattaatctatgaaatactggcctacagtgatgagttgtcaaacagtgatgtggcaaacccggaacatttccttactgcatatcagaatcaacaagcacctcaataactgaaacagccccggatttcaccggggctgtttcgcatttcttacttatacgccgactggtgaacaccaaccgcgcgaccagacggatcgtccattttcttgaacgcttcatcccattcgatcgctttagcggaagaacaagcgacggaaggaccgcccggcacgcactcagcggcgctcggaagcgggaatagttcttcaaagatctcccgatacaagtacgcttctttagaggttggcgtgttgtacgggaagcggaagcgggcagtttccagttgctgatcagaaacctgctgcgcagccacttctttcagggtgtcgatccaactgtaaccgacgccatcggagaactgctctttctgccgccaggccacgcttgcaggcagatacgcttcaaaacattcacgcaggatgtgtttttccattttgccgttaccgcacattttatcctgtgggttaatacgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcagttctttggcattcggtgctttgtggaagtaaagataaccgccgaacacttcatcagaaccttcaccggacagcaccattttaatgcccatcgccttgatcttacgcgacattaaatacatcggtgttgaagcgcgaatagtggtcacatcataagtttcgatgtggtaaatcacgtcgcggatggcatccagaccttcctgtacagtgaagtgaatttcgtgatgcaccgtgcccagatggtttgccacttcctgggctgctttcagatccggtgaacccggcagacctacagcaaaggagtgtaactgcggccaccaggcttcagagcgttcctgatcttccacgcgacgggctgcgtatttcttggtgatagcggaaataattgaggaatccagaccaccagaaagcagcacaccgtaaggcacatcagacatcagatggcttttaactgaatcttccagtgcctgacgcagctcgtttttgtcggtcacgttatctttcaccgcatcgtagtcgaaccagtcgcgatgatagtaagaacggatttcgccgtcctggctccacaaatagctccccgccgggaactctttaatcgtgcggcaaactggcaccagcgctttcatttctgaggccacatacagctgaccgtgttcgtcataccccatatacagtgggatgatccccagatggtcgcgaccaatcaggtaggcatctttttcgctgtcgtacagtgcaaaggcaaacatgccctgcaagtcgtcgagaaattccggccctttttcctgatacagcgcgaggatcacttcacagtcagacccggtctggaactggtaacgatcgccatattcggcgcgcaatgcctggtggttgtagatttcaccgtttaccgccagtacgtgggttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagggctttcttacgcagctcaactgcgtctgttttgatatcgaatacgccaaaaattgaacacataaccttctccgttaacctggtatttgttgcttgttgtgtttgcttgtttaaaaaaatgccgcaaagcagcactgtgcgcaagcgatttggcggtgaaaaaataaaaaacgtaatggtgattgtcgattggtgaaaaaaggtctggtgtgaggatatatttattgatgaatcgataatttttagcgggttttattgaatgtttatattttacgggggccaaattgctgacaaagtgcgatttgttcatgccggatgcggcgtgaacgccttatccggcctacaaaagcatgaaaattcaatatattgcaggagctgcgtaggcctgataagcgtagcgcatcaggcagtttggcgtttgtcatcagagccaaccacgtccgcagacgtggttgctattcagataacgtcgatttcagcgactgacgggtaaatccagctggggcggaaaggcatactgtcgatatcgtcgagcgacgaaacaccagaaagcaccagaatcgtctccagacctgcctggaagccggccagaatatcggtacgcaggttatcgccgacaatcaccgtttcttccgaatgcgcctgcattttgtttaatgctgcgcggatgatccacgggctgggcttaccaacatagaacggtttgcgcccggagattttctcaatccctgcacacaacgcgccacaagcgggataaaaaccgcgcccgtgggtgtccggattggtggcgataaaacgtgcaccgttagcgacgaaataggctgctttatgcatcatgtcccagttgtaggaacgcgtttcgccaacaatcacgaaatcagggttcacatcggtaatagtgaaaccggctttgtacagttcatgaatcagtgcgccttcgcccaccacatacgctttcttgccttcctggcgacgcaggaaatcggcagtcgccatcgcagaggtataaaacacgctgtcaggtacatcgacacctgcggtggcaaagcggttcgccagatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttcaccggcaataacaattttttgcggattaaataagttgatagcaatggcgatggttttacccagatgacgaccgacatactcaattacttccgacgccagactatcgcctttgttcgcggctttgcagatagttttgatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttgccgttgcggccaataaaaatgcgcccgttagagataatcccggccccggttccgcgatggacacgcaccagaatggagtcttcgcaatcctgacttgcaccgaagtagtgctccgccagcgccagactacggatatcgtgaccaacgaaacaggtcactttaaaacgttcttccagagcttctaccagcccccagttttctacctgaatatgcggcatgtaatgaattttgccgctgtccgggtcaacaagccctggcaggatcaccgaaatcgcgatcagctcgcgcagtttgcgctggtagctatcaataaactgagcaatggcattcaacagggcatgttccagcgtttgctgggtacgttccggcagcgggtaatgttcttctgccagcactttgctgctgagatcaaacagagtgatggtggcgtcatgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcagtcaggttggctactttacctgcggcgagtgtgccgagacgtttctcaacgccaatcgcacgcgccggatagagcgtcgccatacgtagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcaataataccgcaataaatgtcagcttcgtcgaggatcgcgcccgccaggccaggttcacgaccggtaatatacggcatcgcgttgtacagatgggtggcaaaggtaatccccgcgcggaaaccggcttttgcttctttcaacgtcgcgttggagtgaccggcagaaaccacaatcccggcatttgccagtttgctgatgacttccgcaggaaccatttccggtgccagggtcactttggtaatgacgtcggcgttttcacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataacaattacagacctttgatattttctgcttctaattcattgaaatatcttaaagtcttaactttcagctccatggtggaaggttcatcgcacaccatgatcgctttcggatgcagttgcagacagctgatggtccacatatggttcacgcaaccttcaacggcggcctgcagcgccagtgctttctggctacccagcaccagaatcatcacttcttcggcatccagcagtgtaccaacaccgacagtcagggcatattttggcacctgattaacatcgttatcaaagaaacgagagtttgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgataataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggcttgaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgctggtgcggcggcgctggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgattgccaccggattcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggtgacattaaccgcttctatgccggtgacggcaccgcggggatgttcatgtccggcttcttcccgatcatgatgttcggtctgccgggtgcggcgctggcgatgtacttcgcagcaccgaaagagcgtcgtccgatggttggcggtatgctgctttctgttgctgttactgcgttcctgaccggtgtgactgagccgctggaattcctgttcatgttccttgctccgctgctgtacctcctgcacgcactgctgaccggtatcagcctgtttgtggcaacgctgctgggtatccacgcgggcttctctttctctgcgggggctatcgactacgcgttgatgtataacctgccggccgccagccagaacgtctggatgctgctggtgatgggcgttatcttcttcgctatctacttcgtggtgttcagtttggttatccgcatgttcaacctgaaaacgccgggtcgtgaagataaagaagacgagatcgttactgaagaagccaacagcaacactgaagaaggtctgactcaactggcaaccaactatattgctgcggttggcggcactgacaacctgaaagcgattgacgcctgtatcacccgtctgcgccttacagtggctgactctgcccgcgttaacgatacgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatattgtggcgggtcaaacaccgctgtatgaaatcaaaaagtaatctgctttatgcctgatgcgacgcttgagcgtcgcatccaacaatgacaagcggtggagatcttctctgccgctttttttttcatcaatcatccccataatccttgttagattatcaattttaaaaaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggaggctcgcgccgaaggattcatcgacgattcaaccttaaccggcggtatctattactggcagcgtgaacgcgaccgtaaagatgttaccgacggcgacaaatacaaaaccaacctttctcactccacctggaatgccaacctcgattttcagtccggttatgctgctgatatgttcggccttgatattgctgcgtttacggcgattgaaatggcggaaaacggcgacagctcccacccgaacgaaatcgcgttttcaaaaagtaataaagcctatgacgaagactggtccggcgacaaaagcggtataagcctgtataaagctgcggccaaatttaaatacggtccggtttgggcgagggcaggttacattcagccaactggtcaaacgctgttagcgccgcactggagctttatgccaggtacttatcagggggcggaagccggggcgaattttgattacggcgatgctggtgcgttgagtttctcctacatgtggaccaacgaatacaaagcgccgtggcatctggaaatggatgagttttatcagaacgataaaaccaccaaagttgattatctgcactcctttggggcgaaatacgacttcaaaaataacttcgtactggaagcggcatttggtcaggcggaagggtatatcgatcaatattttgccaaagccagctacaaatttgatatcgccggtagcccgttaaccaccagctaccagttctacggtacccgagataaagttgacgatcgcagcgtcaacgacctttatgacggcaccgcctggctgcaagcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggataaccgttctgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcctacagcctggatgcggtctataccattcaggacggtcgcgccaaaggcacgatgttcaaactgcatttcaccgaatacgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgctatgaaaaaactgattctcatcgccataatggcatcggggctggtagcttgtgcgcaatcaaccgcgccacaggaagacagtcgtctgaaagaggcatacagcgcctgtatcaacaccgcacaaggttcgccagaaaaaattgaagcctgccagagcgtgttaaacgtgctgaagaaagagaaacaacatcagcagtttgccgaccaggaaagtgtacgcgtactggattatcagcagtgtctgcgtgcaacgcaaaccggaaatgatcaggcggtgaaagccgattgtgataaagtctggcaggaaatacgcagtaataacaaataagtgagagctgtaactctcgcttttcttatttcccttgcataaaaaagccaacccgcaggttggcttttctcgttcaggctggcttatttgccttcgtgcgcatgttcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccgttgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgactccgccagctcgttcagcgcctcgacagcttccgcgttcagcttcagttcgacacgcttaaggccacgtactttgtcgcgttttagctggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgtgcctgtggaaattgagccagtaaatcatcacggtactgctcgctaacatacggagaattgccgccagggataaacagggcagggtgatcccatgccgggattttctcccaacctacaatatgcggatactgatcccacaataccggcacgttaaagcgccactccccgtcaacaaaagatttcagcagaaactgaatcaccccttcttcattaagatgctggcgcattattgctgctgcttgctggcgagtttgtgcgtccgattcactgaccgcgttgatagccgcaaaaatctcatcatgacggcgtacgtgatagtcgaccggcgcgatatcgatcgccaccagtttatcgatgcgatcggaggctagtgcagtaagtgccattaccgctttaccgcccatggagtgaccgataaatgttgctttgtcgatctgctgtgcatccagagtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccgtggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaaacacatttaataaaaaaagggcggtcgcaagatcgcccttttttacgtatgacaaacacagaattgcctgatgcgctacgcttatcaggcctacgaggatggtgcaatatattgaatttaagcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcacctttccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacacattaaaatagtgagtccgggaatgaaacccggacctgaacatgtcttattgcgtgaatgtttctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtacattttcatagaaggtatctaaatcaccggataatgcccactgaagaaactcagaatatccaacttccagactttcccaattcagcgtatctggcgcaaaataataaacgcagccagtatcttccccaagatcgccaccattaagagcaaaaattacccctgcgacatcgtcagcgatgggtaaagcccgcacgcctgcgaattcagggcgttgtgtccaacttactggatctcgtggcaaccgggggtgaccagatcctgctatgcgtaactaaccattatcaatcagcagacctccggagccatagacaagcgcacccatcggtgattttgttgtcacctgtaattgataaagtgcggtttcggctaaatctttattaaccggtaagagttcggtatggtttgtggcgtcttttaaccagttctggattattggccaggctgaatcttcagtatttactaactgattcatttcacgcatcgctacttgctccttgtgtgctacggtgtcatttatgatgaggaattgtatggaacattttttaaatattaagttccttatatttgaataaaaaatgactttatccatacattgccacttttttcaaagcataaaccgatacccaataccggtttcagtaataaaatggcgaggccgggccggatcctgttccagtttttgtcgcagatgccccatataattacgcaaatagttgctgtgttcgatcgcgtttagaccctacatctgccggatgcggcataaataacgaactatttgccaacaaacagaaagggcgatcattcaatcgcccttttttactttgttttattaaccgtgtttatttttcagttcaaagcgtggtgataccagaccatacagtgtccaaccaaggaaggtcacgatggaaccgtacagcatggcttcttccccggatgagtacagcgcataaaagctatacatcgcgccaacaaaagcaacaaagtttgcaactttcgcttttgaggggggcacattagcgaccttctgaataatgactaatgccgccattgacagaatatacggaatgatattggtcaccacggccaggttaaccagcacgttgaactgactgtttagcgacgggctaatggtcatcagtgccaatccactctgaataatcacaatggtcaacattccctgcaccggtgcatccactttggttacacgggagaaaattttagggaagtagccttcatcagatgaagatttaaacacctgggcaatggtgaactgccagccaagtagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtacagcgtcgggctaaaccagaaccagccaataatgcacagaccgacgaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagtgagacgccgtaggtatagttcgccataaagttaccggatttaccgaaagcatactcggcataaccgcccataccgcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacgcccattttgttcgatttagcctgactcataatttttcccctttcaacagggtgctttgcgcatcacgaggcttgatgacatagcaccaaacttgcttacgaccatcatgttcttcgatatagacaccctgcagctccggtgcaaaacctggcagcaggttgatcccttcttccagagcgctgaagtaacgcagaacagcaccaccccagatttcacccggaacaacacacagcacacccggaggataaggaagcgcaccttcggcagcgatacggccttctgcatccggcagacgaaccagttccacttcaccgcgtaaataggcgtagttggcttcttgcggattcatgctgacgcgtgggaagtgctccttacggaacatctctttttgcagttgtttcacgttgtggcgggcatacaaatcatgcatttcctgacacaactgacgcagggtataaccggcgtagcgctcttcatgctgtttgtagatggaaggtagcacttctgctaatggcgcgtcggactcaagcagtttttcgaagcgtaccagcagggcaacaagttgctgaagtttggccatatcttctgccggagtcagcaggaagaggatggagttaagatcgcatttttccggcactacgccattttcgcgcaggaagttagcaagaatcgtcgcgggtacaccgaacgcttcatattcgccgttacgtgcatcaatacctggggttgtcagcaacagtttgcatggatcgacaaagtattgattctctgcatagccttcaaaagaatgccagtgttcccctggtacaaactggaagaagcgcagatcaaccgcaatttgcgctgtttcatacgactgccagggtttaccatccaccagttcaggtacgaacggacgaatatgctgacagttatcgaggatcagtttgcgggcattaatgccatttaccacacaatccatccacatattacgaccgctgacaccttcatgcattttggcgttgatattcagtgcggcaaacagcggatagaacgggctggtggaggcgtgcatcataaaggcgttgttcatgcgtttgtgcggtacataacgctgttgccctttgatgtggctgtcttttttatgaatttgtgaagtctgagaaaaaccagcctgttgtttatgcacagattgcgtaaccagaatacccggatcgttctcattaagatccagcaacagcggcgaacagtccgccatcatcggaataaactgttcatagccgacccatgctgagtcaaacaggatgtagtcacacagatgaccaattttatccaccacttggcgggcgttataaatcgtaccgtcgtaggtgcctaactgaatcacagcgaggcggaaaggacgagcctcttttgcccgctgcggtgcgacttccgcgatcagctcacgcaggtaactttcttcaaaacagtgcgcatcaatgccaccgataaagccatacgggttacgtgccgtttccagataaaccggtgttgcaccagcctgtagcaacgctccgtggtggttagatttgtggttattgcgatcaaacagcaccagatcacccggtgttagcagggcgtttaaaaccactttgttagaagatgaagtgccatttaaaacgaagtaggttttatcggcattaaacacttttgccgcatgttgctgtgcaatgcatggcgcgccttcgtgaatcagcagatcgcccatcgctacgtcggcgttgcacaagtcggcacggaacagcgcctcaccaaagtattccacaaactgattccccgccggatggcgacggaaaaattcgccgccctgatgaccagggcaatcaaacgcgctgttaccttgattgacataatcgaccagtgcgcggaagaaaggtgggcgcagttgagtttcataatggctggcagcggtttctaactggcgaccataaaattctcgtcgcgattcgcaattctcaaagacacccgaaatacggggcaaatactctgcgggtacacgttcttgattttcagtagcaataaataccgggatgccataacccgtggcatcgatttcatcgagttttccgcatgtaacatcgttgagcgataaaactattgccgccacatcgatattacgactttcattaatgtagatacattctcgctgcgtggtaaaacagtccgggcaagaatcactaaccgcaatttttaattttgacatttttcatctctttattttaggtaatagcaggtcctcaatttctcgaatgagaaatcgatcgtgccggaaaaaagcaaagttaccccgctgataaataaatcaggtagattgcttttttcagaatgcagaaacccttaccagtcaggtggctgataatacaagggttaacagagaatgagcactgcggaatacaggcatatgcctgtaatacagagagtcaggaagacctgtacgctgaagtgcccttagtcggtagactaacgggcattgaagaagtgaaagtcgaagctattgcgatgagcaaacttcataatatgagttgtccgccttatatggggcatagtgcggctgttattttccatttaatttacctttcctgatgtgaatgaaggtgaagatattctatccaggaaatacggttgaactgtgaaggtgatcaataaaaaatgatcaatcttaatttatttaatgatgagctttttactcagtaatataaaatattgaattgttatttttgtgtgttgtttaagataaaaagccgtatttattattacggctttaattaataaaaggcaggctgtattaaaattaatattcaaagcataaaccgatagccaataccggtttcagtaatgaaatggcgtgggcgggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaattttaccagcggatcgggcgcggtggtggcagagtggcggcgtaatgcgacgcgcagacgggcctgcaattcgccaatgccaaacggcttactcagataatcatccgctccggcatccagcgcggcgattttgtcgctctcttcgctgcgtgcggaaagcacaatcaccggcaccgcgctccactggcgcaggtcgcggataaactcaatcccatcaccatcgggcaggccgagatcgagaataatcaaatctggcttacgggttgccgcttccagcaagccgcgttgcagcgtttcggcctcaaagacgcgcatcccgtcgccctccagcgccgtgcgcagaaagcgacgaatagcctgttcatcttcaacaatcagaacgtttgtcacatatcctcatgaaattcttcaagttcaggggcagtttgctggggaagtgtaacacgaaaacaggcaccaccttccggtcggttgaacgcggtaatagtgcccccgtgtacatccactatcgcccgacaaattgccagtccaagccctacccccggtactgccgactctttattcccgcgagcaaacttatcaaatatcgtctgctcctggcctggcggaagaccggggccgttatcccagacatccagttgtagattttcgccctcaacgtgggcatcgataccaatttcggcctgcgcacccgcatatttcaccgcgttctccagcagattaatcagcacccgttcaaagagtggcccgtcaacgtggattaaggtcagcggttctggcagagaaagattgatgggcgacgataaacccggttccagcatttgcagcgcgctgccgactacttcttccagcgttaaccactctttcttcaaattaaagccgccggactgaattcgcgccatatccagtagattattcaccagtcgggtagtgttcagcacatgctgacggatctcgctggcctggcgggcgtggggtgatccttcgcttgccagatcgagcgttaagatttctgcctgaccaaacagcaccgtaagcggcgtgcgtaaatcatgcgaaagcgccgccagcagggcgttgcggatctgttcacgttcgcttgccatccgcgcctgttcttcgctggcggttagcgtcagccgctcaagggcattggcgactaacagcgtaaacgtctccagcaggcgctgctgttccgggatcatcaactggcgcagattccccggctccaccaccaccagcccgtaggttttctcgccgctttttagcggcaaaatctggtacggtacaccgggtaacgtgtcggtgcccgcgcccgcaggcaggcctttatcaaaactccactgcgcgatggcatcgtcccacggcgtcattccttgcggatgtgttaacggctgcaatttaccgttgtcatcgggcaacaacacctgactgcgggcatgaaacgtggaggcaataaattgttcgctggtggcagcgatatcctgcggactgcggcccaccgccagagctttcgacatttcatataagtgccgtgtgcgttgctcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcactacattaatgacggtggcaaccactgaaggccagcgtccataaaatagcgccaccaccaccacgccaagcagatacagcatcaccaggttggcggcatcaaacgccatcagccactgcatggcaattaaggtgataacggcgcataacgcggcggcaaccacgcatccctgaatttgtacacgccacttgtctttaaaagagcggttatccggcgcgttgttaatcgtgcgggcgggtggttcatcaagcgcgaccagcacctgatcgagatcgggggcgatgcgcgccagtcggtcagcaaacgtttcccgacgccaccagcggcgcgaggccgggcgaccgagaataatcttgccgagattatgttcacgggcataacgcactaccgctttctcttccgctggatcagaaagtgttgccgtctccgcgcccagttcctgcgccagacgtaaggcgctgagaattgcccgacgttttttttccggtaagcggtgcagggcaggggtttcaacatacaccgcgtgccagacgctacccagccgtgacgccagccgcgccgctgcgcggaccagtttttcgctgccggtgttatggccgatgcataaaaggatcgcgtcgcgcgtgtgccacactttctcttcgccaggatgcccccgccaggcgcgcatttgctcatcaacgcgatcggcagtacggcgcagtgccagttcgcgcagggcgatcagattacctttgcggaaaaaatgttcaatggcgcgctccgcctgcccggcaatatagactttgccttctttcagccgctggcgcagatcgtccgggggcaagtccaccagcaccacgtcgtcggcggcatcgaaaaaaggatcgggcacggtttcccgtacctgaattccggtgacgccgctgaccacatcattcagactttccagatgctgaacgttgacggtagtgaaaacatcaatgccagcttccagcagttcttcgatatcctgccagcgtttgggatgacgggaacctggcgcattactgtgcgccagttcgtccattaagatcagcgccgggcggcgggcgagggcggcatcgagatcaaactcgctgatatgccgcccacggtacgcctggcgttttaacggcagaacagccagcccttccagcatggcggcggtatcttttcgcccgtgggtttctaccacgccaaccacaatatccagcccttgcgcccgcagtcgctgggcttctgccagcatcgcccaggtcttcccgacgcctgcacaggcaccgaagaaaactttcagcttcccccgatgcggcgcggcagtttgttccagcagacgatcggggtcgggacgtaagggttcgttattcatcaagtttatccagcgccagattgagttcaacaatgttgacaaccggctggccgatatatttcaccagcggttgttggctgtattttgcgatcagttgcgtgagctgttcaacgctgagattacgcgctttcgccacgcgtgggatttgccaggccgccgcttgcggggtgatattattgtccagcccgcttgccgatgccgtcaccagttcaaccggaacgctcgcgctggcatccgggttagcggcccgtaatgcagcaacgcgtgcggctattagtttatccagctcagggttactgaccgccagattgctcccgccagaagcctgtggattatagggcatttctgccgttgccgacgggcgaccatgaaaatagccgttgccggtaaaattctgcccgattaatgccgaaccgcgcaccgtatcaccttcacgaatcaacgaaccattggcctgccagggaaaccaccattgccccagtacggtggtcagcagcgggtaaacgccgccagtaatcaataacagaaagataaatgttgataatgccggacgtaatccactcatggtaaacctcacaccagaccgcaaacggtcagcagtaaatcaatgactttgataccgataaacggcaccagcagcccacccagaccgtaaatccataagttacggcgcaacatggcagaagcggtaagcggtttataactcacgccttttaacgccaggggaatcaaaaagacgataatcaaggcgttgaaaatcaccgcactgaggattgcggagtcgggcgaatgcaggcacatgatgttcagcgcatttaactgcggatacgttgccgcgaatgccgccggaataatggcgaagtatttcgccacatcgttggcaatgctgaaggtggtcagcgagccacgggtcatcagcatctgtttgccaatgtgcaccacctcgatcaacttggtcgggttagagtcgagatcgaccatattgcccgcctctttcgccgcctgggtgccggagttcatcgccaccgcgacatctgcctgcgccagcgccggagcatcgttggtgccgtcgccggtcatcgctaccaaacgaccttccgcctgatactgacggatcaatgccagcttggcctccggtgtcgcttcggcgagaaaatcatcgacacccgcttccgcagcaatcgcggcggcagtcagacggttatcgccggtaatcatcaccgttttaatgcccattttgcgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggtagggaagtgaccaccgttagcctcaacatggcgacgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcagccagcgttttttcatccacgccctgcgcggggataaactccgacgcctgacggttaccgagtgtgatggtgccggttttatccagtagcagaacgtcaacgtcacctgccgcttcaactgcacgtccgctggtggcaatcacattcgcgcctagcatccggctcatcccggcgacgccgatcgctgacaacaggccgccaatagtggttgggatcagacagaccagcagcgccaccagtaccgttacgctgactgcattaccgccccacgcggaaaacggccacagcgtggcggttgccagtaaaaagacgatagtcagggcaatcagcagaatggtcagggcaatttcgttcggcgttttgcgtcgctgtgcgccttccaccatcgcgatcatccgatccagaaatgtctcgccggggttaacgctacactcaatcaccagccagtcagaaagaatacgcgtgccgccggtgacggaggcaaaatcgccgccggattcacggatcaccggtgccgattccccggtgatggcgctttcatcgaccgatgcacccccttcaataacttcaccatcgcaggggataatatcgccagcttctaccagtacgatatcgcctttacgaagttggtcggcaggaactttgtccgccgcagcgccatatttcggctcacgcagcttgcgggcaaaggcagtttttttcacccctttcagactgttggcctgcgctttactgcggccttctgccagcgcctcggcgaaattagcgaacagtacggtgatccacagccaaccgctaatggccgcgctaaacagcgcattgccgggcatcgcaccgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcagcgtgccggagctggcggcttggctctttttactcaccagcgaaccggcaattgccatcaccgggataatcaccccgaagcgaccgacaaacatgcagaacgccagtaaacagttccagaacggagagttggcgcttaatccggcaaaggcgctgccgttgttgttagcggcggatgacacggcgtacagcacttcgctaaaaccatgcgggccagggttgagcatggcgctacgtccggcgtcggtcatcatcgccaacgccgcgcccatcagcaccagcgtcggggtaaccagaattgccagtgcagtcagtttcatctcgcgtacgtcgatttttttacccagatattccggtgtacgaccaatcatcagcccggcaataaacaccgccagcaggacaaacagcatcatgccgtaaagaccagaaccgacaccgccgaacaccacttcaccaatttgcatcagccacatcggcaccatgccaccgagagcggtaaacgaatcatgcatcgcaatcaccgcgccacaggaagccgccgtcgtcacgaccgcaaacaggctactgaccagcacgccgaaacggctctctttaccttccatattgatgctgctgtccgtgcccagtgccagcagatgaggattaccctgaacttctgcccacatcaccacgcctacgcagatgacaaaaatcactgacatcgcccacagcaacatgcgcccctggcggcgatcgcccatcacttcaccaaaggcaaagcacagcgccgttgggatcaagaagatcgccagcatctgcacgaagttggtcagtgcggttgggttttcaaacggatgcgacgagttggcattaaagaagccaccgccgttagtaccgagcatcttgatcgcttcctgagaagctacaggccccatgggtaacagctgttgcgctccttcaacggtattcacagcctgataaggcagaaagttttgcagcgcaccttgttgaataaaaaacagtgcaatcaacaacgccacagggactagcacccataacgtgatgcgtagcagatcgacccaggcattcccgagcgtgctcatgctctggcgggtaaacgcacggatgagggcaaaaatcaccgcaatcccgctggcggcagaaagaaagttttgcaccgttaagcccgccatctggctgaaatagctcaacgtggtttcaccgctataagattgccagttggtattggtgacaaagctgacggcggtattcagcgccagatcccacgacagccctggcaactgctgtggattaagcggcagatagtgctgaccgagcaacataaaaaacagcaccgccagccccagcatgttcaggccgagaatggcacaaagatattgcttccagttcatctcacggtcagagacgccaagtgcgcgaaaaagtacgcgctcaacgcccgttgtaccgggaagaggaatgtcattaatcagccgcgccagcccgctgcctaaaggacgcgccagcaccattaacaccagtaaaaacgtggcgatcagtaagaacccttgcgcagccatcagaacgcctccgcattgatcagggcataaaccagataacccagtaataaaaacaccagcaatacgccggttatcacgcctgcactcacagtgcacctccagtggcctaaaagtgataccggaagggtagaattctggctgcaaagatttcgcaaaaatctgcgggcggggtgtaaaaaaagtataaaaatggcaaaagccatgatttaactaatgtttagtattaatttaacttttgtgtaacttaattacaggatgaatgtaaataaaccatcaataagcaaaaataagtggtcggatgagtagtaaaattacacaaaaggcggtactattttcatcagataaacaaattcatttttccggtgccattcaccgggtagatacaaaagggggagaaaagtatggaactctacagagaatatcctgcatggcttatctttttacgccgtacttatgcggttgcagcgggcgttctggcgctgcctttcatgcttttctggaaagaccgcgcccgcttttacagctacctgcatcgcgtctggtcgaaaaccagcgataaaccggtgtggatggatcaggccgaaaaggcaactggtgatttttattgattgctgagttttgaatacattgaaaaccgccagcggaaacgctggcggttttttgtatcaggaagatgttcagaggaatatttagacatcgttataccaatcgaaacatatattcatgaaatatatataaatattttcctaattgttcttatctgacagatatctcacttaaggctttcttataaatctgtagggtttcgcctgtcagcagacaaataacccgataaaacaaggatgagcagatgagcggaaaaccggcggcgcgtcagggcgacatgacgcagtatggcggtagcattgtccagggttcagccggggtacgcatcggtgcccccaccggcgtggcctgttcggtgtgccccggcggggtgacgtccggccatccggtcaatccgctgctcggtgcaaaggtccttcccggtgaaaccgacatcgccctgcccggcccgctgccgttcattctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccccgcggcgaactggcggcggtgtatgaccgcagcaatacacaggtgcgcagctttacttacgatgataaataccggggccggatggtggcgcaccgtcacacgggccgaccggaaatctgttaccgttacgacagcgacgggcgggtgacagaacagctaaacccggcaggcttaagttacacgtatcagtatgagaaggaccgcatcaccatcaccgacagcctgaaccgccgtgaagtcctgcacacgcagggtgaaggcgggctgaagcgggtggtgaaaaaggaacacgcggacggcagcgtcacgcagagtcagtttgacgcggtgggcaggctcagggcacagacggatgccgcaggcaggacaacagaatacagtccggatgtggtgacgggcctcatcacgcgcatcaccacgccggatggcagggcatcggcgttttactataaccaccacagccagttaacgtcagccaccgggcctgacgggctggaaatacgccgggaatatgatgaatggggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcactgactgttccggttatgtaacccgctatgaccatgaccgttttggtcaggtgacggcggtgcaccgcgaggaagggctgagtcagtaccgcgcatacgacagccgtggacagttaattgccgtgaaagacacgcagggccatgaaacgcggtatgaatacaacgccgccggtgacctgaccaccgtcattgccccggacggcagcagaaacgggacacagtacgatgcgtggggaaaagccatctgtaccacgcagggcggtctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaatggcgaaaccgcagagcggtggcagtatgacgaacgcggctggctgacagacatcagccatatcagcgaagggcaccgggtgacggtgcactatggttatgacagtaaaggccgcctcgccagtgaacacctgacggtgcatcatccgcagacgaatgaactgctctggcagcatgagaccagacatgcgtacaacgcacagggactggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtataccacagacccggcaggtaaccgcctgcccgacccggagctgcacccggacagcgccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccggtaccattacgacagtcagcaccggctggtgcactacacgcggacacaatatgcagagccgctggtcgaaagtcgctatctttacgacccgctgggccgcagggtggcaaaacgggtatggcggcgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggtggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggcgcagatgcaaagccagatggacccggtatacacgccggcgcgaaaaattcacctgtaccactgcgaccatcgcggcctgccgctggcccttatcagcacggaagggacaacagcgtggtacgcagaatacgatgaatggggtaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattgggctgaaagggggatggaatttttatcagtatccgttgaatccgatctcaaatatagatccattaggattagaaacactaaaatgcattaagccactgcattcaatgggcggaactggtgaaagaagcggtccagatatatgggggaatccgttctatcatcaatatctttgtgtcccagatggtaaaggggactatacttgtggtggccaagaccaacggggagaatcaaaaggagatggtctatgggggccaggtaaagcaagtaatgatacaaaagaagctgctggccgttgtgacctcgttgaaaccgataatagttgtgtggagaactgtttaaaagggaagtttaaagaggtaaggccgcgttattctgtattgcctgatatattcacacctataaatttagggctatttaaaaactgccaagactggtctaatgattctttagaaacatgtaagatgaagtgctccggaaataacattggacgttttattagatttgtattcaccggagtgatgtaatgaaatatattatttttttattcagagctatatggctggctttatcgcttttaatactattcttttccatgcatagactttcactattagactccactcgtgatgtgagcgagttaattagtctcatgtcttatggaatgatggtaatatgttttccaacaggcatagtattctttattgctctaatatttatagggactgtatcagacattattggcgtaaggattgatagtaagtatattatggcgataataatatggctttattttctgtcaggagggtatattcaatggtttgtattaagtaagcgcattataaacaaataaattaagttaattgctcttattattatatgtaacctgggcattgatatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacggagaaaaccgacctcatcccggaaggggttatccgcacggatgatgagcgcacccaccggtaccattacgacagtcagcaccggctggtgcactacacgcggacacaatatgcagagccgctggtcgaaagccgctatctttacgacccgctgggccgcagggtggcaaaacgggtgtggcgacgtgaacgggacctgacgggctggatgtcgctgtcacggaaaccgcaagtgacctggtacggctgggacggcgaccgcctgaccacgatacagaacgacagaacccgcatccagacgatttatcagccggggagcttcacgccactcatcagggttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgacggtggagcagatgcaaaaccagatggacccggtgtacacgccggcgcgaaaaatccacctgtaccactgcgaccatcgcggcctgccgctggcgcttgtcagcacggaaggggcaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggaggtatatcactcaggatccgattgggctgaaggggggatggaatttttatcagtatccgctgaatccggttcagtatatagattcaatgggactggcatcaaaatatggacacttaaataatggcggatatggagcgagacccaacaaaccgcctacgcccgatccaagtaaattgccggacatagcgaaacaattaagactgccatatcctattgaccaggccagtagtgcgcctaatgttttcaaaacattcttcagagcattaagcccttacgactacacactgtattgcaggaagtgggtaaaaccaaatctgacttgtacgccacaggatgattcccagtatccagggatggatacaaagacagcaagtgattacctgccacagacaaattggccaacaactcaattaccaccaggatatacttgtgcagaaccctatttattcccagacattaataaacccgatgggccagcaacagcagggatagatgatttgggtgaaattttagctaagatgaaacagagaacatcgagaggaataagaaaatgaaaagagttttgttctttttgctgatgatatttgttagttttggtgttatagctgattgcgaaatacaagctaaagatcatgattgttttactattttcgctaagggtactattttttccgcgtttcctgtcttaaataataaagccatgtggagatggtatcagaatgaggacatcggtgagtattattggcaaacagaactgggtacatgtaaaaataataaattcacaccaagcggggcgagactcttaattcgcgtcgggtcactacgccttaatgaaaatcatgccatcaaaggaacgttgcaggagttgataaatacagcagaaaaaacggcgtttctcggcgatcggtttagaagttatataagagcgggtatctatcaaaaaaagagcagtgatccagttcagttgttggcagtccttgataattcaatcatggtaaaatattttaaagatgagaaaccaacttatgctcgaatgacagcacatctcccgaacaaaaatgagtcttacgaatgtttaataaagatacagcatgaactaattcgtagtgaagagaaataaaatctcttcctgagaaaacaaattaatcattgtgaaaaattatataactcatggaataggtgtttattttgcgttccatttgcagggaaagatcacgtaacgctacttttttgtactaaataattcgaattttaagttcaacaattgagatactacttattgtctaaagctgtttttcatagcttatacatgatcaaatactccttacataaataaggtgaacaaatggaacttaaaaaattgatggaacatatttctattacacccgattacagacaagcctggaaagtggtgcataaattgtcagatattctactgttgactatttgtgccgttatttctggtgcagaaggttgggaagatatagaggatttcggggaaacacatctcgattttttgaagcaatatggtgattttgaaaatggtattcctgttcacgataccattgccagagttgtatcccagggaaagatcacgtaacgctacttttttgtactaaataattcgcattttatgtttaaaaattgagatattccttattacctaaagctgtttttcatagcttatacatgatcaaatactccttacataaataaggtgaacaaatggaacttaaaaaattgatggaacatatttctattattcccgattacagataagcctggaaagtagagcataaattgtcaggcatcctactattgactatttttgccgttatttctggtgcagaaagttgggaagatatagaggatttcggggaaacacatctcgatttcttgaagcaatatggtgattttgaaaatggtattcctgttcacgatactattgccagagttgtatcctgtatcagtcctgcaaaatttcacgagtgctttattaactggatgcgtgattgccattcatcaaatgataaagacgtcattgcaattgatggaaaaacgctccggcactcttatgacaagagtcgccgcaggggagcgattcatgtcattagtgcgttctcaacaatgcacagtctggtcatcgggcagatcaagacggataagaaatccaatgagatcacagctatccctgaacttcttaacatgctggatattaaaggaaaaatcatcacaactgatgcgatgggttgccagaaagatattgcagagaagatacaaaaacagggaggtgattatttattcgctgtaaaaggaaaccaggggcggcttaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaaggactgaagaaattatgcgtggcagtctcctttcggtcaataatagcagaacaaaagaaagagccagaaatgacggtcagatattatatcagttctgctgatttaaccgcagaaaagttcgccacagcaatccgaaaccactggcacgtggagaataagctgcactggcgtctggacgtggtaatgaatgaagacgactgcaaaataagaagaggaaacgccgcagaattattttcagggatacggcacatcgctattaatattttaacgaatgataaggtattcaaggcagggttaagacgtaagatgcgaaaagcagccatggatagaaactatctcgcgtcagtccttgcggggagcgggctttcgtaatctttccctgctttttgtactaaataattcgcattttatgtttaaaaattgagatattccttattacctgaagctgttttttattgcttatacatgatcaaatacttcttacataattaaggagaacaaaatggaacttaaaaaattgatggaacatatttctattatccccgattacagacaagcctggaaagtggaacataaattatcggatattctactgttgactatttgtgccgttatttctggtgcagaaggctgggaagatatagaggattttggggaaacacatcccgattttttgaagcaatatggtgattttgaaaatggtattcctgttcacgataccattgccagagttgtatcctgtatctgtcctgcgaaatttcatgagagctttattaactggatgcttgactaccattcttcagatgataaagacgtcatcgcaattgatggaaaaatacaccggcattcttatgacaagagtcgccgtaagggagcgattcatgtcattagtgcgttctcaacaatgcacagtctggtcatcggacagatcaagacggataagaaatccaatgagatcacagctatccctgaacttcttaacatgctggatattaaaggaaaaatcatcaaaaccgatgcgatgggttgccagaaagatattgcagagaagatacaaaaacagggaggtgattatttattcgctgtaaaaggaaaccaggggcggctaaataaagccttcgaggaaaaatttccgctgaaagaattaaataatcccaagcatgacagttacgcaattagtgaaaagagtcacggcagagaagaaacccgtcttcatattgtttgcgatgtccctgatgagcttattgatttcacgtttgaatagaaagggcagctatggttagaaactacctgacgtcagtccttgcggggagcaggctttcgtaaatttgtcctgctacaacaggattaacttcacaaatatcatttctcaacgtctacacttactcctgtaaaccgctcaggagcagtaatgaatctacaacgatttgatgacagcaccctaatccgtatctttgcccttcatgagttacatcgactgaaagaacatggcttaacgcgcggggcgcttctcgattatcacagccgctataaactcgtctttctggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggagttttatgactacccatctggtctggtttcgccaggatttacgtctgcacgataatctcgcactggctgccgcctgccgcaattcgtctgcacgcgtgctggcgttgtatatcgctacaccacgccagtgggcgacgcataacatgtcgccgcgtcaggctgaacttatcaatgctcaactgaatgggctacaaatagcgcttgcggaaaaaggtattcctttattgttccgtgaagtggatgactttgtcgccagtgtcgaaatagttaaacaggtgtgcgcggaaaacagcgttacccacctgttttataactatcagtatgaagtgaatgagcgggcgcgggatgtggaagttgaaagagcgctgcgtaacgtggtgtgtgaaggatttgatgacagcgtgatcctgccgcctggcgcggtgatgaccggtaatcacgagatgtacaaagtctttacgccttttaagaatgcctggctgaaacggctgcgggaagggatgccggagtgcgtcgctgcgccaaaagttcgtagtagcggatcgatagagccctcgccatccattacgctgaattatcctcgtcagtctttcgatactgcgcattttccggtggaagaaaaagcggcgattgcgcaattacgccagttttgccagaacggtgccggagaatatgagcaacaacgagattttccggcagtggaaggcaccagccgtttgtcggccagcctggcaacgggcgggttatcgcctcgccagtgcttgcatcgcttgttggctgaacagccgcaggcgctggacggtggggccggtagtgtctggcttaatgagctgatctggcgcgagttttaccgtcacctgataacgtatcacccctcgttgtgtaaacatcgtccatttattgcctggacggatcgtgtacagtggcagagcaatcccgcacatttacaggcctggcaggaaggcaaaacgggatacccgattgttgatgccgctatgcgtcagcttaacagcactggctggatgcataacaggctacggatgattacagccagttttctggtgaaagatttattgatcgactggcgcgaaggcgagcgatatttcatgtcgcagctgattgatggtgatttggcagccaataacggtggctggcagtgggccgcttcaaccggaaccgatgcagcgccgtattttcgtattttcaacccgacaacccagggcgagaaatttgatcatgagggcgagtttatccgccagtggctaccggaactgcgcgatgtgccagggaaagtggtgcatgagccgtggaagtgggcgcagaaagcaggtgtgacgctggattatccgcaaccgatagtcgagcacaaagaagcgagagtacaaacgttggcagcgtatgaggcggcgcggaaggggaaataacagacgcgtcaggcaatcgagcccagatgccggatgcggcgtgaacgccttatccagcctacaaatttgtgcaaattcaataaattgcaggaaatacgtaggcctgataagacgcgtcaagcgtcgcatcaggcatcggtgctggcctattaagactccagcgccagcgcgcggtttctgaatttcagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcgatcgcgccagaaagcagcatgtagatgccggttaatacgccggtcacaccggggatttcaatgcgcgtaatttgcgacatggcaaccgggtcgataaacagttccgcaaagcccatcaccgccaggcctaataccatcagtggcagagaagagtgaccatacattgcggaccagcgggcgcttaaggtcagaatgcagaatccggcgctcatcaggccaaggccaagagcaaatttcccccagatgcgcacggtacgattacccgcgacactctcttttaccacccacgccaggaacacaccgcacagcataactgcgaaggcattaatcgactggaacatcgcggtcggaacggtataaccaaacatatcgcggttaacgaagcggtcgatataaaggctaatcgagctaccgccctgttgtgcgaaggcccagaacaacatactgaagaaggtgagcgtcacaatcagccccagctccttccgctgtttctggttttctgctttgcgataaatttttgccagtacacccaggccaataatagtcgcgacaattaaggcgtataccgaccactctttccagaacagtatggtaatcagtgcaggcgttgccaccagcagaaccagcagccatccccagttcggcaggagaaagtttgtcgcacgcagtacttttttgttaacgccgcgggtatgagtgaaatgacgattgccacataagaaaatgaccagacccgcgatcatgccaaccgccgccaggccaaagcccatcgcccagctgtactcttcctgggcgtaaccacaggcgataggtgcgataatagaccccacgttacccgccgcatacatcagcgagaaaccgccatcacgacgcggatcggttggctcatacagctcgccgagcagacagcttacgttagatttaaacaggccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatacaccagcgaacagtaggcgctaaataactcgtaggcgtgagtatcgttgtattttagttgattggtgagatagagaatcagcagggcacgcatgccgtaaaagctaaaatattcccagatttgcagcgcaacgacatagtaaatagcgcgcggctgtgatgcgtgtttattcataataattccacaattgacggcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgggtttgtttcttaatatgtcaaaagattggctatcgacgaactggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcaccgccagccaggctttgctcgatgaggcagtgcgtctgggcgcggatgcggtcattgtgcatcatggctacttctggaaaggagagtctccggtcattcgcggaatgaagcgtaaccgtttaaaaacgttgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggagctggcttcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtgctggaactggaaccgccggtgacgctggctagccagaaacggatctggcgactggcgcagcgtctggtggatatgccgaatgtggttgaagccattcccggcatgaacaatatcacggtgattttgcgtaatcctgagtcgctggcgctggatgccatagagcgtttgcaacgctggtgggaggagagcgaggcgctggagccggagtctcgctttattgaaattccggtggtttacggtggtgcaggcggaccggatttggcggtggtcgcggcgcattgcgggttgagcgaaaaacaggttgttgaattgcactcctccgtggaatacgtggtctggtttttaggttttcaaccgggcttcccgtatctcgggagtttgccggaacaactacacacgccacggcgcgctgaaccgcgcttactcgttccggcaggttctgtcgggatcggcgggccgcagactggtgtttatccgctggcaacgccgggtggctggcagttgattggtcatacctcactcagcctgtttgatccggcgcgtgacgaacccatcttattacgtccgggagacagcgtgcgctttgtaccgcagaaggagggagtatgctgaagattattcgtgcgggcatgtataccactgtgcaggatggcggtcgtcacggttttcgccagtcgggtatcagccactgcggcgcactggatatgcccgcgttacgcattgctaacctactggtgggtaatgacgccaatgcccccgcgctggagatcacgctcggtcagttaactgttgagttcgaaactgatgggtggtttgctctgacgggtgccggttgcgaagcgcggctggatgataatgccgtctggaccggctggcgattgccgatgaaagcaggccagcgtttaacgcttaaacgcccgcagcacgggatgcgcagttatctggcggtcgcgggtggtattgatgttccgccggtaatgggctcatgcagcaccgatctcaaagtggggattggcgggctggaaggccgtttactgaaggatggtgaccgactcccgattggcaaatcgaagcgtgattctatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccgggcgtggtgcaggtgccacataacgggcagccgattgtgttgatgaacgacgcacagaccaccggtggttacccgcgtattgcctgtatcattgaggctgatatgtaccatctggcgcaaattccgctcggtcagccgattcattttgtccagtgttcactggaagaggcactaaaagcacggcaagatcagcaacgttattttgaacaattagcgtggcggctgcacaatgaaaattgacctgaacgccgatctgggcgaaggctgcgccagcgacgcagagctattaacgctggtttcctctgccaatattgcctgtggatttcatgcaggcgatgcgcaaatcatgcaggcttgcgtgcgtgaagcaataaaaaatggtgtcgcgattggcgctcacccgagttttcccgacagggaaaattttggtcgcagcgccatgcagctgccgccagaaaccgtttacgcccagacgctgtatcaaattggcgcgctggcaacgattgcccgtgcgcaaggcggcgtaatgcgtcatgtcaaaccgcacggcatgttgtacaaccaggcggcgaaagaagcacaactggcagacgccatcgccagagcggtatacgcttgcgatccagcattgattctcgtcgggctggcgggaagcgagctgattcgtgcaggcaagcaatatggtctgacaacgcgcgaggaagtgtttgccgatcgcggttatcaggctgacggctcgctggtgccgcgaagccagtcaggcgcgttgattgaaaacgaagaacaggcgctggcgcaaacgctggagatggtgcaacacggcagagtcaaaagtatcaccggcgaatgggcaacggtcgcggcgcaaacggtctgcctgcatggcgacggcgagcacgcactggcgttcgcccgccgactacgctctgcatttgccgaaaaggggattgttgtcgcagcataaccccgattaataaagaatgaaaaaaggatatcaccatgcctgaaggcccggagatccgccgtgcagcggataacctggaggcggcgatcaaaggcaaaccactaactgatgtctggtttgccttcccgcagttaaaaccttatcaatcacaacttatcggtcaacacgttacccatgtggaaacgcgtggtaaggcgttgttaactcatttttccaacgacttaacgctctacagccataatcagctttacggcgtctggcgcgtggttgataccggcgaagagccgcagaccacgcgagtattgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtgaaagaacgattattgtcgccgcgctttcgtaaccgtcagtttgctggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcgattttcctacgctacgcgggggcaggtggatgagaataagcatcatggggcgctgtttcgctttaaggtttttcatcgagatggcgaaccgtgcgaacgttgtggcagcatcattgagaaaaccacgctgtcatctcgcccgttttactggtgccctggctgccagcactaggccgaccgcttcggcgcataggttgaaataaaccgcgcaatggcaggccctgtcagcaaaatactgaacaggcgtagggtttgcatcgccataatgagcgccatatcggcattgctccctgcggcgatgaccgccacggtatcaagcccgccggggctggtggcgaggtaggcagtcataaaatcaatgtgcataaaccgggtcagcccccacgccatacccgcacaaatagccagcagagcaaaaatcgacagcaggatttgcggtagcgggcgtagtgcccgcagtaagatttgtttatcgaaaccaagaccaatccgccagccaattgccatatacgccatcgccagcagccattccggtagttcgatggtgatgagctgaccagactggagcactgcgcccgccagcatcgggatgagcatcgtgccggaaggaagacgcagcaggcatcccactgtaccggcaacgaccgcgagcaaaatagtaagcaggagattaatgctcactggcgggaaccagacgatatgctggttaaccgcttcagcgttatcgcccagcatcatgcgggtgaccagaacagcggcccccgcgacgaacagcactcgcagatattgcataaacgccaccaggcgaatatctgcgccgtaatcttgcgccatagcgaccattgccgccgcgccgccaggagaggagccccaggcaccggtatttccaggcaatgagctatagcgcaccaataaccaacccacaatggcgctggaaagcagcgttaccagtaaaattgcaagcacgatcggccagttgacggccagggtggtgagaatcgaaccagtgaggttttgcgcaatcatgcagccaagaatggcctgggcggcgagaaaagcagagcggggaagttgcagagtaattccgcgcatactaaagatgatcccggcgatcatcggcccaagtaatagcgccgccgggagatgtaccgcgaggaaaccaatagaaaggagaagtgatagcacacataacattccccactgcaaaactggcatccttcgctccctcattattttctctttggtgtatcgatacagcataaagaaagctgggccaggaaaaaataacagcaatcaaggaaaaggggaaaatcagcaattttctgaaagagatgccctttccggcggcaaagggcatcatggtaaatcagttatagttaatcttaaaaagcaccactgtatcgaaggggccagcctcgatgggggtgcctggaatggacgaaagttcagccgtataggttttttcgtagaccaacatgtcactggtgaaatcggcgtattcagcatatttattgaaggtataaggcgaggcgttttcatccagtaaacgtagcttcagaccattaccaatcaacaatgctttatcttcttcaaccaacgtttcttcggtataaaaggaggaactgactttaaatccgtcggtgcattgatcgttttggctcttggtcgttttaatactgaacgttttcgacattgtgtggcgacgtatatccagcaaattaaatttaccaaaatcaatcacctgtgtttccggtgaaatggaaaaattgacgctgcaatccagcacgcgaatgttttccagaccagtaatatgatatttcaggttttgggcagtagggtcttcgttaacgctaccggcaccgtcaaattgcacgacgatatagtcgctaagcgtactttgataatcatgcggcggcatttctcgtattttgacgtataaccgcatgcgagcgagaaaggtacgcgacatatgaatattagcgggatcgcccgagcaaattttgttctgccatcccatcgcgatgatctgctcaggggtataaatatcaatgttcttactgtcgatacactggttagtgtcgatgcgactttttcccagactggcatcgtaatcgacaccgttgtatgtcacgccgagttgataataacgatcctgcacccccggataggggtttacccaggcgtagacatgctcgctttcaaagttgccgttggtattgttgtcacaatagacgggaattttaatatcgtcagattcccagatcttatcaccgggtttggcattgcctggtacagcaaacggttgaatcgcttctgatttttctactgcgccaccagatgtaccaaaatagcagttcagcgccattgcagacttcaacggcagaaataacaggcagatgacgagcaacaatcccttgccagcactcatttcgcctccactgcttgtaaacggcattgtccgctgcagttgagcgtcgtcatgcgtaatgcgccgtaatcatccatgtaaccgagataaaactggctgccgctataacttccggtgtttgtgttgaccgtactaaaaggtgcaaccatcacggttttgaagcctgggagaacgcctttttcatttctccccagataggcaatggtcagataatacgcggtaggatttttcagtgtcagttggttgccctgctggctgacctgtaactgcagttcgaccttttctcctgctttcttgcgtaatgcagccggtcgccagaacaatttaatacgactttgaatagcgacctgaagtatcgcatggtcgctgcttttatccggagcgggaggaatttcgcgcatattgtagaaaaatagcgtttcgcgatcgccaggtaattgtgtggttgaggcttgtttcacaacccgcacctgcgatgtcgctttcggttccagacgttgaatagggggcaaagcgaccagaagagcatcgcttttctcccctttttcattttctatccaggaataagcaagataaggcagtttgtcactttggttttcgatacgcaggctggtggctttgtcattggcgttaaacacaatgcgtgtgcgatcgggttgcaccgcagcattgcaacccaagctgatggttaacaacattaagggtaatcctttaataaatgtcattctcttttccttaattaatgacaaggtaaaatcaggcgtttggtcgtgtcttccagacgttctggcagatgaataatgcagctttgctcaccccagaccacggtaaacagttgattttcagcgacaccgcttaaccaggcatgtccttcctcgccaaccatacccacgctaatgccgctgtcatcctggcggatatccgcaccgaggggagggaactgaccgctggcgttgcgtatgatgacgttaacgtctttaccggaacgggaagccagtgatttgtaacctatcgcgccttcaatccatgtttccttgatgacgttttctgcaactgttacgccgtcgggtaagtcattcatgttcaccgccacggtggaaggctggtaactggaaatcaacggcaccaccgcaatgccaaaatggttggtgtagtcgagattgccctgaaccggaatatctgccacgccatcggtgctgaccatcaggcgtggttcattggtggagctgcggcgatgaaatgctgcaccatattgggttgcggtgaaagaaccgctccagctgctgctgacggaactgtaatcactggcggcataggtaccagaaatatcccactcacccgctgaactcaggtgctgatagttaccgctcacctgggctccattgtccggacgatcggattgcagtccggcagacatgccccagctattacgttcatccagcgtatcgttccacgacatgcggtgtatggtgctgtggctactgttttgcatgtcatagccaacccgaccaccgttaccgaaggggagcgaaatcgacagataaatctggttgtcgcgatctttatcttcgtagtgggtcgtattgaatgacgtcgaaatcgagatatctctccagtcaccaatatcaacattaaaacctgctgtgatgttggcggtcgtggaggcgtctgcattccaccaggtttgatgtagcaggttggcgtaaagattgaggtttagtggggtaatcggttggcccacggataagctgatcgtctgtttttcgtcctgcgcatcgctgtcgttgtatttgtgatccagatagttggcgtagctgtgaaaatgacgatctgagaagcgataagcggcgagcgaaatcgtgctgttggtggcatccacttgtttgctgtaattaaaacggtagcttaagccccgctcgtcctgctgagtatcaaaatggctactggcccaggtgacatcaaaggacagtgcgccaagccacagcatattttgcccgatacccattgcggcagaatggtagtcatcatcagaaatcagcaggccgccgtacagcgaggtgtttgagagcatcccccaggaaacttcattgctaaaaaaggtttcattttcagtttgatgtgacatggaaggccgtggctgacccgcggccaatttatagcgaacctgtccctggcgagtcaggaagggcgtcgatgctgccgaaacctggaaattgttcacccgaccatcttcttccgtcactttgacatccagcgtgccctgaacagactgattgaggtcatcaataataaacgggcctggcgggacttttttctggtaaatgacgcggcctgattgactgatcgtcaccgtggcattggtctgtgcaataccgctaatttgtggggcgtagccacgcagctcccacggtaacattcgatcgtcactcgccagtgccgcgccggtataagaaaaaccatcgaaaatattggaactgaaatcggtttcgccgagggttaacttagagcctaattgcggtaatggacgaaaaagataggtgcgcgatattccgcctgactggtcatggttatcttcgctatcggtcttattaagctggtaatcactgcgtaagcgccatgccccggcgttaattccggcggtaccgtaggcattcaggttagtgctgctgctgccgtcctgtgggcggtagctgctggcaaacaagttgtaatccatcaggacaccggcaacaccttctttccatgtagaggggggagcccagttttctgagtgccacgccagccaggcttgcggaatactaatattcagttgctgattggcttgatcgaaattgaagagcatttcaggtcgggaactgaaatcaatacaccgatctatctgtggcaaggactgacggatatctggttttaaaccaaatttatcgaccagtgaatcattgatgcatggaatggttttgtcaccctttttttgccagttaattttttgcccattactgattttgttgttattcaccgcaacgctaacaaaatattcaccgggagcaatgactcctttttcctttaataatgaaatatcaatgcggtcgcgcattgatttatcgagaacattcagattgaattcgaccgccattgcgcaaggcatcgccatgaccaggcaggatacaaaagagagtcgataaatattcacggtgtccatacctgataaatattttatgaaaggcggcgatgatgccgccaaaataatacttatttataatccagcacgtaggttgcgttagcggttacttcacctgccgtgacatcgactgcattatcaatttgttccatccaggcgaaaaagttcagcgtctgttctgatgagcttgcatccaggtcaagatctggcgcggctgaacctaatacgatgttaccgtcatttttgtccatcagtcgtacaccgaccccagttgcttcgcctgcactggtgttgctcaacaaaggcgtagcaccagttgtcttagccgtgctatcgaaggttacgccaactttggataccggcattccgctaccgttgtcagaagcaggcagatcacagttgatcaagcgaatgtcgacggccactttattgctatgatgctcccggtttatatgggttgtcgtgacttgtccaagatctatgtttttatcaatatcttctggatgaatttcacaaggtgcttcaataacctcccccttaaagtgaatttcgccagaaccttcatcagcagcataaacaggtgcagtgaacagcagagatacggccagtgcggccaatgttttttgtcctttaaacataacagagtcctttaaggatatagaataggggtatagctacgccagaatatcgtatttgattattgctagtttttagttttgcttaaaaatattgttagttttattaaatgcaaaactaaattattggtatcatgaatttgttgtatgatgaataaaatataggggggtatagatagacgtcattttcatagggttataaatgcgactaccatgaagtttttaattgaaagtattgggttgctgataatttgagctgttctattctttttaaatatctatataggtctgttaatggattttatttttacaattttttgtgtttaggcatataaaaatcaacccgccatatgaacggcgggttaaaatatttacaacttagcaatcaaccattaacgcttgatatcgcttttaaagtcgcgtttttcatatcctgtatacagctgacgcggacgggcaatcttcataccgtcactgtgcatttcgctccagtgggcgatccagccaacggtacgtgccattgcgaaaatgacggtgaacatggaagacggaatacccatcgctttcaggatgataccagagtagaaatcgacgttcgggtacagtttcttctcgataaagtacgggtcgttcagcgcgatgttttccagctccatagccacttccagcaggtcatccttcgtgcccagctctttcagcacttcatggcaggtttcacgcattacggtggcgcgcgggtcgtaatttttgtacacgcggtgaccgaagcccatcaggcggaaagaatcatttttgtctttcgcacgacgaacaaattccggaatgtgtttaacggagctgatttcttccagcattttcagcgccgcttcgttagcaccgccgtgcgcaggtccccacagtgaagcaatacctgctgcgatacaggcaaacgggttcgcacccgaagagccagcggtacgcacggtggaggtagaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcattttcgacagcaggcggaacgcggcaatttcacggtgacgaggattgttaacatccagcgagtcgtgatagaacgccgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtatccccgttgagggtgagttttgcttttgtatcagccatttaaggtctccttagcgccttattgcgtaagactgccggaacttaaatttgccttcgcacatcaacctggctttacccgttttttatttggctcgccgctctgtgaaagaggggaaaacctgggtacagagctctgggcgcttgcaggtaaaggatccattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacctggatcactgttcaggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaaaccgtaggcctgataagacgcgcaagcgtcgcatcaggcaaccagtgccggatgcggcgtgaacgccttatccggcctacaagtcattacccgtaggcctgataagcgcagcgcatcaggcgtaacaaagaaatgcaggaaatctttaaaaactgcccctgacactaagacagtttttaaaggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtagtagtttaagtttcacctgcactgtagaccggataaggcattatcgccttctccggcaattgaagcctgatgcgacgctgacgcgtcttatcaggcctacgggaccaccaatgtaggtcggataaggcgcaagcgccgcatccgacaagcgatgcctgatgtgacgtttaacgtgtcttatcaggcctacgggtgaccgacaatgcccggaagcgatacgaaatattcggtctacggtttaaaagataacgattactgaaggatggacagaacacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataatgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccctctacaggaatggcgaagggctgtcggtttcgacatggttggccatcgtatgatggccttttttgtgcttatcgcgatgattttcgctgcgctatcagggtaaatttatagtcatcggtattaaaagcgttgcggctatattcaaacacccgaccatcaactaaatatccacgcgatactttttcaagaatcggctttgtctggctgatattaagcagacggctcatctcttcggttggcatcagaggaatgatttcctgttcgctacgatcgataaccattttcttcacttcttcgataaagtgatatttcgaattttccatgacctgccaggtgagatccgggaacaacgcaagcggcatccaggtttcttccagcgccattggcttttgcttgcgatagcgcacgcgcttcacatgccacacacgatcctgcggggtgatttgtagctgttgctgaagaaaatcgtcagccggaatcacttcgaatatcagaacttcactgtgtgtatcgacgtgacggtccgacagtttttcatcaaaactggttaactgaaaaatatcgtaattgacccgctcttctttgacgtaagtcccgctgccctgaatgctttcgaggatctgctgctcgactagctggcgcaaagcctgacgcaccgtaacccggctgacgccaaactctgtttgtagcgctgattcagtgggtaacgcatcgccaggtttaagctcgccacgcgcaatttgttcacgaatgcgatcggcaatctgccggtataagggcttgtgtcccatttttagtatctcattaatacgaatttaaccattatgcccgataaattcatcctgtaaataatacaaatacaatacaaataatttcaatcaagtgaaattgatcacataatggtattgttttatcgggcacactggcgcgactataaaaacgatcaagtgaggatcatgatgaatctgacgactctgacccaccgcgatgcgttgtgtctgaatgcgcgctttaccagccgtgaagaggccatccacgcgttgactcaacgtcttgctgctctggggaaaatttccagtactgagcaatttctggaagaagtgtatcgccgtgaaagccttggcccgaccgccttaggtgaagggttggctgtgccgcatggcaaaactgctgcggtaaaagaagcggcgtttgcggtcgccacactcagcgagccgcttcagtgggaaggcgttgatggcccggaagcagttgatttagtggtgctgctggcgattccccccaatgaagcgggtactacgcatatgcaactgctgacagcgctgaccacgcgccttgcggatgatgagattcgggcgcgtatacagtcggcgacgacgcctgatgagttgctctcggcgctggatgacaagggaggcacgcaaccttctgcctctttttccaacgcgccaactatcgtctgcgtaacggcctgtccggcgggtattgctcacacctatatggctgcggaatatctggaaaaagccggacgcaaactcggcgtaaatgtttacgttgaaaaacaaggcgctaacggcattgaagggcgtttaacggcggatcaactcaatagtgcaaccgcctgtatttttgcggctgaagtcgccatcaaggagagtgagcgttttaatggcattcccgcgctttcagtgcctgttgccgagccgattcgccatgcagaagcgttgatccaacaagcgcttaccctcaagcgtagcgatgagacgcgtaccgtacagcaagatacgcaaccggtgaaaagtgtcaaaacggagctgaaacaggcactgttgagcggaatctcttttgccgtaccgttgattgtcgcggggggcacggtgctggcggtcgcggtattactgtcgcaaatcttcgggctacaagatctgtttaatgaagaaaactcctggctgtggatgtaccgcaagctgggcggcgggctgctcggaattttgatggtaccggtgctcgcggcctataccgcctattctctggcagataaaccggcgttagcgccaggctttgcggctggacttgccgccaacatgatcggctccgggtttctcggcgcggtcgttggcggattgatagccggttacttgatgcgctgggtgaaaaatcacttgcgtcttagcagtaaattcaatggattcctgactttttatctctacccggtgctcggtacgttgggagcgggcagtctgatgctgtttgtggtgggggaacctgtcgcctggatcaataactcgcttaccgcctggctgaacggtctgtcaggaagtaacgcgctgttgctgggtgccattctcggttttatgtgttcctttgaccttggagggccagtgaataaagccgcttatgcattctgcctgggcgcaatggcgaacggcgtttacggcccgtatgccattttcgcctccgtcaaaatggtttcggcatttaccgtaaccgcttccacgatgctcgcaccgcgcctgtttaaagagtttgaaattgagaccgggaaatccacctggctgttagggctggcaggtattaccgaaggggcgatcccgatggcgattgaagatccgctgcgggttattggttcgtttgtgctgggctctatggtaacgggcgctattgtcggtgcgatgaatatcggcctttcgacacccggtgccggcattttctcgctctttttacttcatgataatggcgcgggcggtgttatggcggcaattggctggtttggcgcggcattggtgggggctgcaatctcgactgcaattctcctgatgtggcggcgtcacgcggttaagcatggcaactatctgactgatggcgtaatgccataaacaaaaaggaaacgacgatgaaagcagtatctcgcgttcacatcaccccgcatatgcactgggatcgagagtggtatttcaccaccgaagagtcacgtattctgctggtcaataatatggaagagatcctgtgccgactggaacaggacaacgaatacaaatattacgtactcgacgggcaaacggcgatcctcgaagattatttcgcggtgaaaccggaaaacaaagaccgtgtgaagaaacaggtagaagccggcaagttgattatcggcccctggtatacccagaccgataccacgattgtttctgcggaatccatcgtccgtaatctgatgtacggaatgcgtgactgcctcgcgtttggcgagccgatgaaaataggttatttaccagattcctttggcatgtccgggcaactgccgcatatctacaatggatttggcattacccgcaccatgttctggcgcggatgttcggagcgccacggtactgataaaaccgagtttttgtggcaaagcagtgacggtagcgaagtgacggcgcaggtgctgccgctgggctacgccatcggtaagtacttacctgccgacgaaaacggattacgtaaacgcctcgacagttattttgacgtgctggaaaaagcgtctgtaaccaaagagattttgctgccgaatgggcatgaccagatgccattgcagcaaaatatcttcgaagtgatggataagctacgtgagatctaccctcaacgtaagtttgtgatgagccgctttgaagaggtatttgagaagatcgaagcgcagcgagataatctggcaaccctgaaaggggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgcccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggctgcgcgccagccagtttaatttgcgggacgatcgcggtcagcctgtaccgtattttattcgccatgcccgtgagatcgatccaggcctaatcgatcggcaaatagttcattacggtaattacgatccctttatggagtttgatatacagatcaaccagattgtcccttctatgggctatcgcacgctttatatcgaagcgaatcagcctggcaacgtaattgcggcaaaaagtgacgctgaagggatactggaaaatgctttctggcaaattgcgctcaatgaggatggttctctgcaactggtagataaagacagcggtgtgcgctatgaccgggtattgcaaattgaagaaagctctgatgatggtgatgaatatgactattcacccgcaaaagaagagtgggtaattaccgcagcgaacgcgaaaccgcaatgcgatattattcatgaagcctggcagagcagggctgttatccgctatgacatggcagtgccgctcaatttgtcagaacgcagcgcccggcaatccactggcagagtaggggtggtgttggttgtcactcttagtcataacagcaggcgtattgatgtggatatcaatcttgataaccaggctgacgatcatcgccttcgtgtcctggtccctacaccttttaacaccgacagtgttctggcagatacgcagtttggttcgctaacgcgccccgtgaacgacagtgcaatgaacaactggcagcaagaaggctggaaagaagcgccggttccggtatggaatatgctcaactatgttgccttacaggaagggcgtaacggcatggctgtctttagcgaagggttacgtgaatttgaagtcatcggtgaagagaagaaaacctttgccattacgttgctgcgtggcgtgggcttactgggcaaagaagatctgcttttaaggcctgggcggccttcgggaattaaaatgccagtcccggactcacaactacgtggtctgctttcttgtcgcctaagtttattgagttataccggtacgccaaccgccgctggtgtagctcagcaggcgcgagcatggctgactccagtacagtgttacaacaaaatcccatgggatgtgatgaagctcaacaaagccggattcaacgtgccggaaagttatagtttgttgaaaatgcccccagtgggatgcctgataagcgcacttaagaaagctgaagaccgacaagaagtgattttacggctgtttaatccggctgaatcagcaacctgtgatgcgactgttgctttcagtcgcgaggtgatttcttgctcagaaacgatgatggatgaacacattaccaccgaggaaaatcaaggttcaaatctatcggggccttttttacccggccagtcacggacgttcagttaccggcttgcctgaatagcaatcaaaccgaagccacatatgcgcggccagattgttgacaaagggcgctttgttcatgccggatacggcatgaacgctttattcggtctacaaaagcaggcaaattcaatatattgcagagatgatgtagacactggcaagcgtagcgcatcaggtaattttgcgtttatcttcactctcaagccacgtatatgtggctttatttttaacaaaataataaccctgggtgagttaattataatataattataagttaactaaatgttaatattggcggggtggatttatgcctttattagtaatcctgaaactctgcgtcgtattagccagtgaccaaaaaaagaattaaggtcaaccgtgctgtttttgcttcgtctctttttatctttaattgccaaccgaaactaatttcagccttataactcacacattttaaacataaatgtcactaaagttaccttattgaaacatgattaacataatttgtaggaattgatatttatcaatgtataagtcttggaaatgggcatcaaaaagagataaattgttctcgatcaaattggctgaaaggcggtaatttagctataaattgatcaccgtcgaaaaatgcaaatttgcttcaacaaaaacctgtttattgtaaggattttgcggcgtaatatatacgtgggatcaatttgagtttttattaacatgtttgcaacctttctttacgccgtttttgtgtgcattcacatggtatgatgaaagtgttcaaacaaatttctattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctctccggcaaacagatttataaagatatgaccaagttctggggcaagttgtttggtatcaacttcgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcgaacggctggatgcaaaacccaatcgcgtccgatttcaactttgaaactatgcgtatggagatggtgagcttctccgagctggtgcttaacccggttgctcaggtgaaattcgttcacactgtagcgtctggttatgtgactggcgcgatgttcatcctcggtatcagcgcatggtatatgctgaaaggtcgtgacttcgccttcgctaaacgctcctttgctatcgctgccagcttcggtatggctgctgttctgtctgttattgttctgggtgatgaatccggctacgaaatgggcgacgtgcagaaaaccaaactggctgctattgaagccgagtgggaaacgcaacctgcgcctgctgcctttactctgttcggcattcctgatcaggaagaggagacgaacaaatttgcgattcagatcccttacgcactgggcatcattgcaacgcgttccgtggataccccggttatcggcctgaaagagctgatggtgcagcatgaagaacgcattcgtaacgggatgaaggcgtactctctgctcgaacaactgcgttctggttctaccgaccaggcggttcgtgaccagttcaatagcatgaagaaagacctcggttacggtctgctgctgaaacgctatacgccaaacgtggctgatgcgactgaagcgcagattcaacaggcaaccaaagactccatcccgcgtgtagcgccgctgtactttgcgttccgtatcatggtggcgtgtggcttcctgcttctggcaatcatcgcgctctctttctggagtgtcatccgcaaccgcattggcgagaaaaaatggcttctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcaatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccattgcaccacactgggacggtaaccaggtttggctgatcaccgcgggcggcgcactctttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtaattggtgtagcgttcggtaacctgttgcagggcgtaccgttcaacgttgatgaatatctgcgtctgtactacaccggtaacttcttccagttgcttaacccgttcggcctgctggcaggcgtggtgagcgtagggatgatcattactcagggcgcaacctatctgcaaatgcgtaccgtgggcgaactgcacctgcgtacccgtgcaacggctcaggtggctgcgctggtgacactggtctgtttcgcactggctggcgtatgggtgatgtacggtatcgatggttatgtcgtgaaatcgacaatggaccattacgcagcctctaacccactgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtgttctcctccctgacgctggcctgcatcatcctgacagccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgaacacgtcgaatcaggcaaagccggtcaagaagacatctgatgagtaagattatcgcgactttgtatgcggtaatggacaagcgccccctgcgggcgctttccttcgtgatggcgcttctgttagcaggatgtatgttttgggacccatctcgttttgccgcgaagaccagtgaactggaaatctggcatggtttattgctgatgtgggccgtctgtgctggtgtgattcacggcgtgggctttcgtccgcagaaggttctttggcaagggattttttgcccattgcttgccgatattgttctcattgtcgggctgattttcttcttcttttaaatcagaattctctttaaaaaattatgggccgctccaggcccataaatttttacgctcccttaacttgccctcattcccaaacctcaatcgcgcgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcacttcagtcagcaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgctgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcttgggccattattatccagcggacccgtattcttaacgcagcggcgcgcgaagccgaagcgtttgaagataaattctggtctggaatcgaactctctcgcctctatcaagagagccaggggaaacgggataatctgactggttcggaacaaatcttttacagcgggttcaaagagtttgtgcgcctgcatcgtgccaatagccatgcgccggaagccgtagtggaaggggcgtcgcgtgctatgcgtatctccatgaaccgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgactgcaattggtctgtttgccgctatcccggcagttatggcctacaaccgcctcaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgcctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgcatgcaaagccaggaatcaagcgcgaagcgttctgatgaacagcgcaagatgaaggaacagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagctgaagaggcggcagcgaaagcggcggcagatgctaaagcgaaggccgaagcagatgctaaagctgcggaagaagcagcgaagaaagcggctgcagacgcaaagaaaaaagcagaagcagaagccgccaaagccgcagccgaagcgcagaaaaaagccgaggcagccgctgcggcactgaagaagaaagcggaagcggcagaagcagctgcagctgaagcaagaaagaaagcggcaactgaagctgctgaaaaagccaaagcagaagctgagaagaaagcggctgctgaaaaggctgcagctgataagaaagcggcagcagagaaagctgcagccgacaaaaaagcagcagaaaaagcggctgctgaaaaggcagcagctgataagaaagcagcggcagaaaaagccgccgcagacaaaaaagcggcagcggcaaaagctgcagctgaaaaagccgctgcagcaaaagcggccgcagaggcagatgatattttcggtgagctaagctctggtaagaatgcaccgaaaacggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaggctgcgttggcagcagctaaacttgcgaagatcccgaaaccaccaagccaggcagtatatgaagtgttcaaaaacgcgccattggacttcaaaccgtaatcgcgatgttgactgttcggacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgcgctcgtctgccacagcagccgggtagtgcgcaggaagtacaaccagctgcatggtccgcactgggcattgacgctgtagttgtcggtcaggtcactccgaatccggatggttcttacaatgttgcttatcaacttgttgacactggcggcgcaccgggtactgtacttgctcagaactcgtacaaagtgaacaagcagtggctgcgttatgctggtcataccgccagtgatgaagtgtttgaaaaactgaccggcattaaaggtgcgttccgtactcgtattgcctacgttgttcagaccaacggcggtcagttcccgtatgaactgcgcgtatctgactatgacggttacaaccagtttgtcgttcaccgttcaccgcagccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagtctgaacctgtacgtaatggatttggcttctggtcagatccgccaggtgactgatggtcgcagtaacaataccgaaccgacctggttcccggatagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacatgcaaacttcctgcgtagcaacccgtcttacaaagtcaccgtagaaggtcacgcggacgaacgtggtactccggaatacaacatctccctgggtgaacgtcgtgcgaacgccgttaagatgtacctgcagggtaaaggcgtttctgcagaccagatctccatcgtttcttacggtaaagaaaaacctgcagtactgggtcatgacgaagcggcatactccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactttctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgcggcggcatcaacgacgccgacagctgatgctggtactgcgaatgctggcgcgccggtgaaaagcggtaatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtactattttgcttcggtagtgaaaaactatccgaagtcaccaaaggctgcagatgcgatgtttaaagtcggcgtcatcatgcaggacaaaggtgacaccgcaaaagcgaaagccgtataccagcaggttatcagtaaataccctggtactgatggcgctaaacaggcacaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccaatcgctaaggtggaagcggtagtaaaacgtgaaggataacgttgcatgagcaacggcccgaagggcgagacgaagtcgagtcatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccagttttaacatcgaagacagatgttaagcgtgtaggataacgttgcgtcagcaacggcccgtagggcgagcgaagcgagtcatcctgcacgacccaccactaatgacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccagttttaacatcaaactcagatgttaagcgtgaaggataacgttgcgccagcaacggcccgtagggcgagcgaagcgagtcatcctgcacgacccaccaatcttaaagattggccccgagtaaaaatctttcaggtaacacccgtatgggtcgttagctcagttggtagagcagttgacttttaatcaattggtcgcaggttcgaatcctgcacgacccaccaatttaaaggtggttactggtagagaacgtgaaggataacgttgcgttagcaacggcccgaagggcgagacgaagtcgagtcatcctgcacgacccaccatcctgaatgattaaggcagcataatcccgcaaggggtcgttagctcagttggtagagcagttgacttttaatcaattggtcgcaggttcgaatcctgcacgacccaccaatgtaaaaaagcgccctaaaggcgcttttttgctatctgcgatactcaaagattcgaacctgcagcaggtttgagttgagcgcagcgaaacaacggagccgctcgcggcgacggcccgaagggcgagcgaagcgagtcatcctgcacgacccaccaatgtaaaaaagcgccctaaaggcgcttttttgctattcaggcatcctcaatttcactttgtaaacctgatgacatcgtcagagcttactgtgcaagcaactctatgtcggtggaattaggcgtaaaatgacgcatcctgcacattaggcgtaattcgagtgacttttccccaccattcgactatcttgtttagcatataaaacaaattacaccgataacagcgaatattacgctaatgtcggttttaacgttaagcctgtaaaacgagatggtaagatgagcgtaatgtttgatccagacacggcgatttatcctttccccccgaagccgacgccgttaagcattgatgaaaaagcgtattaccgcgagaagataaaacgtctgctaaaagaacgtaatgcggtgatggttgcccactactataccgatcccgaaattcaacaactggcagaagaaaccggtggctgtatttctgattctctggaaatggcgcgcttcggtgcaaagcatcccgcttctactttgttagtcgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatcttgatagtttgggtgaaaaaatcatctgggcacccgacaaacatctggggcgttacgtgcaaaaacagacgggtggagacattctatgctggcagggtgcctgtattgtgcatgatgaatttaagactcaggcgttaacccgcttgcaagaagaatacccggatgctgccatactggtgcatccagaatcaccacaagctattgtcgatatggcggatgcggtcggttccaccagtcaactgatcgctgctgcgaaaacattgccacatcagaggcttattgtggcaaccgatcggggtattttctacaaaatgcagcaggcggtgccagataaagagttactggaagcaccaaccgcaggtgagggtgcaacctgccgcagctgcgcgcattgtccgtggatggccatgaatggccttcaggccatcgcagaggcattagaacaggaaggaagcaatcacgaggttcatgttgatgaaaggctgcgagagagggcgctggtgccgctcaatcgtatgctggattttgcggctacactacgtggataacgaataataaggcgtaacgttacgctttgggggaaagatggatttttttagtgtgcagaatatcctggtacatataccaataggggcaggcggttatgatctctcatggatcgaagcggtaggcacgatcgccgggttgctgtgtattggccttgccagtctggagaagatcagcaactacttctttggcctgatcaacgtcaccttgtttggcattattttctttcagattcagctgtatgccagcctgctattacaggtgtttttctttgccgcgaatatttacggttggtatgcgtggtcgcgacaaaccagtcagaacgaggcggagttgaaaattcgctggttgccattgccgaaggcactcagctggttggcggtttgcgttgtttcgattggtctgatgacggtatttatcaatccggtgtttgcatttttgacccgcgtggcagtcatgatcatgcaagcattaggattacaggttgtgatgcctgaactgcaaccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgcgctcaacggcagccggatgtggatcaacagcgcacgtgaaagaggctcacgcgcgctgtcccattaatggtgatgatgtgaatggccagacaccccttcattcaggtggcagtctggcccatgacaaggttgatattccatctgaatggtggcgtgctcaatctgatagtgatccatcaggtagtgttggatctgatccaacaaggcatcgtgatcgtgtggcgggatcacctgcacatgcaacgtcatcaccggcttctcgcctaccatccatacatgtacatggtgcacattgcggacttccgggatttcccggcacatacgacgcttcagttcagcgatatccagcgataccggtgcaccttcaagtaattcattcacgctatctttcaacagtcgccacgcgctacgcagaaccagaagcgacaccagtatcgagagaatggggtcagcaggtgtccagccagtccagataataatcaacgcggcaataatagccccaaccgaacccagcaggtccccgagcacatgcagtgccgctgctcgtacgttgaggtttttctcttcgctgccgtgatgaagtaaccagaaagaaagtatatttgccagcaacccagccacggcaattgccatcatcatgccgccctcgaccggacgcggcgtgcggaagcgttctatcgcctcccagacaatcaaaatggtaattaccacgagggctatggcattcacaaacgccgcgagcgtggtcagtcttagccaaccgaaagtgtggcgaatggtgggaggacgacgtgaaaattgcacggcgagtagggcgaaaagcagggcggcagtatcggtcaacatatgacccgcatcggccagcaatgccagagaaccagaaagaaaaccaccaacgacttctaccagcataaacccggcagtcacgccgaaagcatacaacaagcgacgagcattattatcttctggcaggtgtgaggacgtgtgtgagtgtgagtgcgccatgacgagtcatcccttaattattctcacttaactttatgacatcatactgcttttagaagtgaaaaattaaaagggagagactccgctctcccattattggctattttgcagggttactgcgtggtaccgtcggttttggtatcgacatcattattgatgccatcaccggtttgtacctttttattgatatccggacagcgaccatctttgcacatggtgttcttgtgctcttcatctttggtcattccgtcattgttcattgaagaaccatccgaatgcagcattgtgccgccagaaccggtatttaccccgttattgtcgacgttatttggcgcgacattttcacgggcgtcaggggctacctggcccgcatcagctgcggcgtttgcctggccgttattagtttgcgctccgctatcggcagccagtgcggcaccgctggcaaggcttagagtggcagtcagaaataatgtggccagttttgtcattttcataggatgctcctgttatggtcgttatgtcggataacctcttccaacagtgcatttgcaggtgaatataaggcattggtttaagatttcagccaggttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaaggtttaattgtcggatgcgccgtcagagtggcgtatccgatgaatcaccacaggcctgataagtcgcgcagcgtcgcatcaggcaatgtgctccattgttagcaacaaaaaagccgactcacttgcagtcggctttctcattttaaacgaatgacgtttacttcgctttaccctggtttgcaaccgccgctgctttcgctgcgatctcgtcagcattacccagataatagcgtttcagcggtttgaaattctcgtcgaactcatacaccagcggcacgccagtcgggatattaagctcaagaatctcttcttcgctcatgttatcaagatatttcaccagcgcacgtaaagagttaccgtgtgcagcgatgatcacgcgctcaccgctcttcatacgcggcagaatagtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcactgcaaaaccacgacgccactgtttcacctgctcgtcgccatacttttcagcagtttccgctttgttcagaccctgcaacgcaccgtagtgacgttcgttcagtttccaggatttctcaacgggcagccatgcctgatccagttcgtccagcacattccacagggtatggatagcgcgtttcagcacagaagtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgcgacgaagcaacagcaatgcttacgcataaccatagcgaaaatagtggcgcagtgtaaggttgttgtgaatattgagttgcaaatatgtcggtgtttgctggtgatttgaacaatatgagataaagccctcatgacgagggcgtaacattactcagcaataaactgatattccgtcaggctggaatactcttcgccaggacgcaggaagcagtccggttgcggccattcagggtggttcgggctgtccggtagaaactcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaatgcgtgatcgtaacctttcactttgcgctgatcgtcgtcggcaagaaactcactggcgatgattttggcgctgcggaaatcaaaagacgttccggcgacagatttcaggccgtcgtgcggaatgccgccttcatcaaccggcagatattcgtccgccagaatctgcaacttgtgattgcgcacgtcagactgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaagccctgatcaccatcatctgaactcagggcaaacagcacctgacgatcgttctggttcacaatctgccagcgacgtttgtcgaacccttccggcccgccgtgcagctggttaacgccctgacttggcgaaagcgtcacggtttcaccgtcaaaggtataacggctattggcgatacggttggcataacgaccaatagaggcccccagaaacgcggcctgatcctgatagcattccgggctggcacagccgagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggatcagcgcgacgatacagccgccaaatccgccgccggtcatgcgtacgccacctttgtcgccaatcacagctttgacgatttctaccagagtgtcaatttgcggcacggtgatttcgaaatcatcgcgcatagaggcatgagactccgccatcaactcgcccatacgtttcaggtcgccttgctccagcgcgctggcagcttcaacggtgcgggcgttttcagtcagtatatgacgcacgcgttttgccacgatcgggtccagttcatgcgcaacagcgttgaactcttcaatggtgacatcacgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcaatcgatcagcaaggcatgatctttcttgccgagcgcggaaattagctgatccatgatcccgcagttacagcctacaaactggttttctgcttcctgaccgttaagcgcgatttgtgcgccgtccagcggcagatgataaagctgctgcaatacggttccgaccgcgacttccagtgaagcggaagaacttaacccggcaccctgcggcacattgccgctgatcaccatgtccacgccgccgaagctgttgttacgcagttgcagatgtttcaccacgccacgaacgtagttagcccattgatagttttcatgtgcgacaatgggcgcatcgagggaaaactcgtcgagctgattttcataatcggctgccatcacgcgaactttacggtcatcgcgtggtgcacaactgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtctctgccagcatttcataaccaaccataaatttacgtacggtggcggagcgcagcagaggcggataaaagtgcgcgtgcagctgccagtgttgattctcttcgccattaaatggcgcgccgtgccagcccatagagtaggggaaggagcactggaagaggttgtcataacgactggtcagctttttcaacgccagcgccagatcgctgcgctgggcgtcggtcaaatcggtgatccgtaaaacgtgggctttgggcagcagtagcgtttcgaacggccaggcagcccagtaaggcacgacggctaaccagtgttcggtttcgacaacggtacggctaccgtctgccagctcgcgctgaacataatccaccagcattggtgatttctgttcggcaaaatattctttttgcaggcggtcttcgcgctcagcttcgttaggcaggaagctatttgcccaaatctgaccgtgcggatgcgggttagagcagcccatcgccgcgcctttgttttcaaaaacctgcacccatgggtacgttttccccagttctgcggtttgctcctgccaggttttgacgatttccgtcaatgctgcaacgctgagctctggcagcgttttactgtgatccggtgaaaagcagatcacccggctggtgccgcgcgcgctctggcaacgcatcagcggatcgtgactttctggcgcatctggcgtgtcagacatcaaagccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcacggtcggctttgctggcgtccgcccagtaggccggaaggtcgccctcgcgacgcggtgcaaaatgataattaaccggtttgccgcaggctttgctgaaggcattaaccacgtccagcacgctgttgcctacgccagcgccgaggttgtagatgtgtacgcctggcttgttcgccagtttttccatcgccacgacgtgaccgtccgccagatccattacgtggatgtaatcgcgtacgccagtaccatcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaaccgggttgaagtagcgcagcagggcaatgctccagtccggctgggctttttgcagatcggtgaggatctgttccaccatcagcttgcttttgccgtaagggctttgcggtgtgccggtcgggaagctttcaacgtatggaattttgggctgatcgccataaacggtggcggaggagctaaaaataaagtttttgacgttagcggcgcgcatggcgctaatcaggcgcagagtgccgttgacattgttgtcgtaatattccagcggtttttgtaccgattcgcccacggctttcagcccggcgaagtggatcacggtgtcgatagcgtgatcgtgcaggatctcggtcatcaacgcttcgttacgaatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaagaatttagccgttttttatgcgcgattaagtgattataaaacagagggtttatgaatgattgcgctttttatctgaaaaaagacgcggtttcatgcctgcatgcgtcgaaccgttggccggagagggtgctaaggccgcctccggcaaggtcagcactaccgactcaatatatttttgtcagcacatagcgatagagtccaccgtccggcacgaactcaagacgatgggtaatacaggcaggcgcatcttcagcgtggtgcgaaacaaacaacaattgcgtttcaccttcgctaatcagcacatcaacaaaacggcggataagctggcgattcagcggatcaagcccctgtagtggttcatcgagaataagcaacgtcggatgtttcaccagtgcgcggacaatcagcgccagacgctgctgtccccaggaaagactatggaacggagcgtcagccgtgcgtttatcaatgccgagaatatccagccactgctgcaccagtttttgctggcgatccgaaacggcctgataaatgccaatcgaatcaaaatagccagaaagaatcacattacgcacggtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaaccaggcttaataacgtcgattttcctgcaccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatccggctccggcagttgcacaccttcaagctgttcactatgcgccagttgcgcgacgagtgcttgttggagcagttcctctttagcgccagtttccgctaacgtgcaatccgccagcacgccagcaaactggacaaactccgggatctcatcgaagcgattgagcaccagtaccagagtaataccggactgatgtaacgaggcgagtcgctcagccagctgctgacgtgaggcaacatccaggccatcgaacggctcatcaagaatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggtgcatcctttacttcatcctgaatgatctcagccgtagtgcgtccggtgtcatcttcgccagggccgagcatatcggtgttattccgctgccattcgtcgctgacgagtttttgcaattgctcgaaggagagacgagtgatgtgggaaaactggctttgccgttcacctttcaaaagcggaagttcccccgccagcgcgcgggccagggccgatttcccgcttccattcgaaccgacaaacgcccaactatcacccgcgtttaacgttagctgaggcaattgcagcgtttttgtgtcgctaagacgaaacgtgccttgcaaaatttgcaacgatgacattttatatcccactttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacccggtaattggttgtcagcgttttgcgcgaccgcctcgtcctgagtaatacctacccacggcgcttttagcaatatcaacacttctttgccttcatccagccccagacgcgcgccgctttgtgcggtaattgcgactttcaggcgtgtttttccgtcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctggatttgcgccagtaagtcatagagctgaatcagtcgctgaccatagcgggtcagtactgcgccgccgccacctttaccgcctgttgcgcgctcgaccagaatatgctcacttaactgattcatctcgttaatggcatcccaggcgcttttatagctaataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgcttttcctgccgatattttttcttatctacctcacaaaggttagcaataactgctgggaaaattccgagttagtcgttatattgtcgcctacataacgttacattaaggggttaccaatggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaatgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaatcatgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcttccagcatactgatatcattaaagttatcgccgaatgccacgacgttttccatcgaccaaccttgcgcctcaacccatttcgtcaaacgtttacctttgctgttgccgccgcgtgcaatatcaacctgatcgtgccaggaccattcacactccagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagatgtgcgaatgacatgcccggtcgggtgctcatagaccattgcatcatcgacatacatcagaccgtgaatgtggtgttcattcagcatctcaatgagttgcagggctttaataacgggcattgggtccgcttccagcacggtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttcttacaatgcgggtaacgtgagcgtaacgcgtctggaagatggcctgccagtgggcgtcgtcgatgtggtcgaggggctggacggttgccattccgccaatatctcaccggacaaccgtacgctgtgggttccggcattaaagcaggatcgcatttgcctgtttacggtcagcgatgatggtcatctcgtggcgcaggaccctgcggaagtgaccaccgttgaaggggccggcccgcgtcatatggtattccatccaaacgaacaatatgcgtattgcgtcaatgagttaaacagctcagtggatgtctgggaactgaaagatccgcacggtaatatcgaatgtgtccagacgctggatatgatgccggaaaacttctccgacacccgttgggcggctgatattcatatcaccccggatggtcgccatttatacgcctgcgaccgtaccgccagcctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggtcgggcagggaccaatgtgggtggtggttaacgcacactaaccgctgatttacccggcgcagtctctcctgcgccggtgtattaacctatctcctgtaacgcgtgtctctggcgttcgacgatattggtccacaaattgtctttatcgtcagtccataaattaatcagcaaggcaaaaaagcgttctgctgctggagaaagtacggcatctttacggcgaattattcccaatgttcgacgtataacgggttccaccaatgggataccaataatcgaagaatagggcgcatgaggcattgccaggccaggaagcgccgaaatccccagtcccgcctccaccagtcctaatgacgtcgaaagatgacgcacttcgtaaaaccagtccagcttccagggcttgtcggccagctgttgttctatcaacagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttctttattaattcccgcgcctccgggagcaacctttttcctgcttttgttaacgtaaccttgcgagttgtacgctcaaatagttgaacatgtaaatcttcctccatcttttttattcttcgcgttaatgcaggttgcgtaatattgagtaatttagcggcattgttaaacgaactggactctgccagtatgacaaatgccttcatacttgataattcatgcttcattattactccggaaaatggaagcgacgattttgggtggctggccgttaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccactgaccagtaaagtcgccattattagccgttccagcgatccgcgtgctgatgtcgattatctgtttgcgcaggtaatcgttcatgagcaacgtgtcgataccacgcctaactgcggcaatatgctgtctggtgttggggcattcgccattgaaaatggtttgattgcagcgacttcgccagttactcgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgctggaaccaaaaccggaaaagttttcccgactgataatcagattgattattttgacgatgtcccggtgacctgtatcgatatggcgatgccagtcgtcattattccggctgaatatctgggaaaaacaggttatgaattaccggcggaactggatgccgacaaagcattattagcccgcattgaatctatccgtctacaagcgggtaaagcaatgggcttaggtgatgtcagtaatatggttatccctaaacctgtgcttatttctccagcgcagaaaggcggggcaattaatgtgcgttattttatgccgcattcttgccatcgcgcgctggcgataaccggtgctattgctatttccagtagttgtgcattggaaggcaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaaattcgttgtcaggataaggacaatcaataaaggacttctgtatgagtcatacagaaagaacaggattttaaatgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaaatattctcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaaaaagcgccatgtgaatgtaggtcgcattcggcacttattgtcggatgcgatgcttgcgcatcttatccgacctacgaatcgcatcgaatctgtaggccagataaggcattttcgcagcatccggcacttattgtcggatgcgatgcttgcgcatcttatccgacctacaaatcgcatcgaaccgtaggccggataaggcgtttacgccgcatccggcaaatagttaattgctcttacttcttcgcctctgcaaccactttactacccacgccgcggttattgtattcccacatgcggttgtagttagtgtcattcagattgcgctgtatttcgtcgttatcatctacgctgccggtattacccgcaaacggacgattagagatcaccgcatcggcccacggtttagccgtgttaaaaccttcgttgatggcgctatcacggatcaccacctgaccgttggtattggcatcaacatccagcgagcggcccagttgcgccacaccatcaccgaaagcattgaaacggctgtttacggcgaggaaaccgtagtaaatgttggacagcgtagccggtgcaaacacatacgcttcttgctgagtacgtgagttcaccacgcggaattcggtgttatcgaacaccactgcgccgcgaccagaaacgatatccacatccccttcaatgtagctgttggtcaccagcgtacgcggctgacgattcgtttccagacggttctgcacaccgctgttggtgacaaagaaggtgttctgacgaccgagaatgttaacgttgttaatctgtacctggtcaccatcagtacgcagtgccaccgccggatggttacctgcatctacgctatcgcccagcgtgttttcgatggtcagattttgcagttgcaggccattgttttgtgaccagaagaccgcagagcagagaacaccgatactgtcgctgcgtttgctctggcagctatcgtacatataccacgctggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatataccgttccctgatactcaccaggcatcacggcaatatactggcgcttgttggtacgcttgataattgccgcatctaccgccgcctgaatcgtggtatgcgttacaccttgagtgcccgccgggccgacaacaaagtcaggttgcgcaggcagggtaatcggggaaggattccacgctgcagcacctggtgtcagggatgcaaaatagtgttgagcatcgaaattctgcgcttcttttgccgacagaatcgggcgagaagaggtaccaggcgcggtttgatcagaaggacgttgatcgggcggggttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcgcttgccagagagtggaaatgaacgttaaacccgaccatcgcgccgctggcaccttcatcgacatcaatacgttctatatccagcgcgtgaacggtaaaaatgtagcgatgagtttcgcctttcggcggtgctgcgccatcgtacccggttttaccaaagtcggtacgcgtctgcaaaacgccgtctggcattgctaccagaccagagccaaacccttgcggtaatacgcgggtatcagcgggtaagttaacaactacccagtgccaccagccggagccggttggcgcatccgggtcgtagcaggtgacaacaaaacttttcgttcccgcaggaacatcatcccacgccagatgcggtgaaatattatcgccatcgtaacccatgccgttaaagacatgacgatgcggcaatttatcgccatcgcgcagatcgttactgatgagtttcatgaaccctcctttcttgtttgcagaaagtgtagccagaaaccctcacgcggacttctcgttattggcaaaaaaatgtttcatcctgtaccgcgcggttaaccgctgcggtcagacgctgcaactgttgcgggagaataatatagggcggcatcaggtaaatcagtttgccaaaaggccggatccagacaccctgttcgacaaagaatttttgcagcgccgccatattcaccggatgagtggtttcgaccacgccaatggcccccagtacgcgcacatcggcaaccatttcggcatcacgggcgggggcaagttgctcgcgcagctgtacttcaatatccgccacctgttgctgccagtcgccagattcgagaatcgccaggctggcgtttgctgccgcgcaggccagcggattgcccataaaagttggcccatgcataaagcaaccggcttcaccgttactgatggtttctgcaacctcgcgcgtggtgagtgtggcggaaagggtcattgtgccgccggttaaggctttaccgaggcacaaaatgtccggcgcgatttctgcatgttcacaggcaaacagtttcccggtacgaccaaatccagtggcgatctcgtcggcaatcagcaagataccttcgcgatcgcatattttgcggattcgttttaaccattccggatggtacatgcgcatcccgcctgcgccctggacaatcggctcaatgatcaccgccgcgatttcatgacgatgcgccgccatcaggcgggcaaagcccaccatatcgcgctcatcccattcgccatccatgcggctttgcggggcgggagcaaacaggttttctggcaggtagcctttccacagactgtgcattgagttatccggatcgcacaccgacatcgcgccaaaggtatcgccatgataaccattgcggaaggtcagaaaacgctggcgcgcttcgcctttggcttgccagtactgcaacgccattttcatcgccacttccaccgctacggaaccggagtccgcgagaaaaacgcactccagcggttgcggcgtcatcgccaccagtttgcggcacagctcaatggctggcgcatgggtgataccgccaaacatcacatgcgacatggcatcaatttgcgacttcatcgccgcattaagctgcgggtgattgtagccgtggatcgccgcccaccaggacgacataccgtcaaccaggcgtctgccgtcagacaaaatcagctcgcaaccttcggcgctcaccaccggataaaccggcagaggggaggtcatggatgtgtatgggtgccagatatggcgttggtcaaaggcaagatcgtccgttgtcataatcgacttgtaaaccaaattgaaaagatttaggtttacaagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgccagcatttcgatcctcgtcaggtgcaggtcagcacgttgctgtcgattaagaccggagcttgtccggaagattgcaaatactgcccgcaaagctcgcgctacaaaaccgggctggaagccgagcggttgatggaagttgaacaggtgctggagtcggcgcgcaaagcgaaagcggcaggatcgacgcgcttctgtatgggcgcggcgtggaagaatccccacgaacgcgatatgccgtacctggaacaaatggtgcagggggtaaaagcgatggggctggaggcgtgtatgacgctgggcacgttgagtgaatctcaggcgcagcgcctcgcgaacgccgggctggattactacaaccacaacctggacacctcgccggagttttacggcaatatcatcaccacacgcacttatcaggaacgcctcgatacgctggaaaaagtgcgcgatgccgggatcaaagtctgttctggcggcattgtgggcttaggcgaaacggtaaaagatcgcgccggattattgctgcaactggcaaacctgccgacgccgccggaaagcgtgccaatcaacatgctggtgaaggtgaaaggcacgccgcttgccgataacgatgatgtcgatgcctttgattttattcgcaccattgcggtcgcgcggatcatgatgccaacctcttacgtgcgcctttctgccggacgcgagcagatgaacgaacagactcaggcgatgtgctttatggcaggcgcaaactcgattttctacggttgcaaactgctgaccacgccgaatccggaagaagataaagacctgcaactgttccgcaaactggggctaaatccgcagcaaactgccgtgctggcaggggataacgaacaacagcaacgtcttgaacaggcgctgatgaccccggacaccgacgaatattacaacgcggcagcattatgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaataaacaagccattgcagcggcatttggtcgggcagccgcacactatgagcaacatgcagatctacagcgccagagtgctgacgccttactggcaatgcttccacagcgtaaatacacccacgtactggacgcgggttgtggacctggctggatgagccgccactggcgggaacgtcacgcgcaggtgacggccttagatctctcgccgccaatgcttgttcaggcacgccagaaggatgccgcagaccattatctggcgggagatatcgaatccctgccgttagcgactgcgacgttcgatcttgcatggagcaatctcgcagtgcagtggtgcggtaatttatccacggcactccgcgagctgtatcgggtggtgcgccccaaaggcgtggtcgcgtttaccacgctggtgcagggatcgttacccgaactgcatcaggcgtggcaggcggtggacgagcgtccgcatgctaatcgctttttaccgccagatgaaatcgaacagtcgctgaacggcgtgcattatcaacatcatattcagcccatcacgctgtggtttgatgatgcgctcagtgccatgcgttcgctgaaaggcatcggtgccacgcatcttcatgaagggcgcgacccgcgaatattaacgcgttcgcagttgcagcgattgcaactggcctggccgcaacagcaggggcgatatcctctgacgtatcatctttttttgggagtgattgctcgtgagtaaacgttattttgtcaccggaacggataccgaagtggggaaaactgtcgccagttgtgcacttttacaagccgcaaaggcagcaggctaccggacggcaggttataaaccggtcgcctctggcagcgaaaagaccccggaaggtttacgcaatagcgacgcgctggcgttacagcgcaacagcagcctgcagctggattacgcaacagtaaatccttacaccttcgcagaacccacttcgccgcacatcatcagcgcgcaagagggcagaccgatagaatcattggtaatgagcgccggattacgcgcgcttgaacaacaggctgactgggtgttagtggaaggtgctggcggctggtttacgccgctttctgacactttcacttttgcagattgggtaacacaggaacaactgccggtgatactggtagttggtgtgaaactcggctgtattaatcacgcgatgttgactgcacaggtaatacaacacgccggactgactctggcgggttgggtggcgaacgatgttacgcctccgggaaaacgtcacgctgaatatatgaccacgctcacccgcatgattcccgcgccgctgctgggagagatcccctggcttgcagaaaatccagaaaatgcggcaaccggaaagtacataaaccttgccttgttgtagccattctgtatttggttaaattgcgagcgagatcgcgtcttcgattgactgcaatttaaccaattaaattctaaaataatcacgaaaaaaattttacttccgcctcatgcggcgaatgtgggaattgcccaggcggcgggggataggggctggagacagttatccactattcctgtggataaccatgtgtattagagttagaaaacacgaggcaagcgagagaatacgcggcttgcacgcgaattggcgttaaagacggctcaaagaaatatcttttattttttaactggttagataaatgcaatggcagtcactgaacaggcatctcttgccataaaactgtcatcactcatcttgacaaatgttaaaaaagccgttgctttggggataacccggtaaggccggagttttatctcgccacagagtaaattttgctcatgattgacagcggagtttacgctgtatcagaaatattatggtgatgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccagaggcgattcgacgtctcgaagaggggctggaagatggcctggcgcaccagacgttacttggcgtgactggctcagggaaaaccttcaccattgccaatgtcattgctgaccttcagcgcccaaccatggtacttgcgcccaacaaaacgctggcggcccagctgtatggcgaaatgaaagagttcttcccggaaaacgcggtggaatatttcgtttcctactacgactactatcagccggaagcctatgtaccgagttccgacactttcattgagaaagatgcctcggttaacgaacatattgagcagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaagcattccagcgtggtactttccgcgttcgtggcgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacaccgcgcgagcgcatcgtacaggcgatggaggagatcaaagaagagctggccgccagacgcaaagtgctgttggaaaacaacaaactgctggaagagcagcggctgacccagcgtacccagtttgatctggagatgatgaacgagctgggctactgttcggggattgaaaactactcgcgcttcctctccggtcgtggaccgggtgagccaccgccgacgctgtttgattacctgcctgccgatgggctgctggtcgtcgatgaatctcacgtcaccattccacaaattggcggcatgtatcgcggtgaccgggcgcgtaaagagacactggtggagtacggcttccgcctgccatcagcgctggataaccgtccgcttaagtttgaagagttcgaagcattagcgccgcaaaccatctatgtttcggcgacgccgggtaattacgagctggaaaaatccggcggcgatgtggtggatcaggtggtgcgtccaaccggattgcttgacccgattatcgaagtgcggccggtggcgacacaggttgatgatcttctttcggagattcgtcagcgagcggcaattaacgaacgcgtactggtcaccacactgaccaagcggatggcggaagatcttaccgaatatctcgaagaacatggcgagcgcgtgcgttatcttcactcagatatcgacaccgtcgaacgtatggagattatccgcgacttgcgtctgggtgagttcgacgtgctggtagggatcaacttactgcgcgaaggtctggatatgccggaagtgtcgctggtggcgatcctcgacgctgacaaagaaggcttcctgcgttccgaacgttcgttgatccagaccattggtcgtgcggcacgtaacgttaacggtaaagcgattctctacggcgataagatcaccccatcaatggcgaaagcgattggcgaaaccgaacgtcgccgtgagaaacagcagaagtacaacgaggaacacggaattacgccgcaaggcttgaacaagaaagtggtcgatatcctggcgctggggcagaacattgccaaaaccaaagcgaagggcagaggaaaatcgcgcccgattgttgagccggataatgtgccgatggatatgtcgcctaaagcgttgcagcagaaaatccatgagctggaagggttgatgatgcaacacgcgcagaatctggagttcgaagaagcggcgcaaattcgtgaccagttgcatcagctgcgtgagctgtttatcgcggcatcgtaacaggatagcgaagaagactgatgacaaacggaaaacagcctgatgcgctacgcttatcaggcctacattttctccgcaatatattgaatttgcgcggtttgtaggccggataaggcgttcacgccgcatccggcataaacaacgcgcactttgtcttcaataggaagccggaattttccttcggatttccgttaacctaaagcctgtaacgccttttccagcgcgttatgtaacaactggcggtcatgacgatacggaatatcgctggcctccagtacctcctggatcacaatccgctctttcaccgccgagacatccacttttggcccgacgatgaccgcatcaatgacctttttaccaacatactgctccataattgccagcttgctttccagcttcaaattagccgcaggtaaactcaactcacgccccagattgccgatataaaccatcggcgctggcgtgcggcgtaatgcctgggcgatttccttcagcagcagaattggcatcaggctggtataaaaactgccaggcccaataatgatgagatccgcttcattgatagcgtgaaccgcctcacgcgttgcgggtacattaggcgttaacaataactcttgaatcggcgtagttaactggtcgatattgacctcgccgtaaacttcatgcccctgatcgtcaatcgccatcagatcaacaggatgctctgacattggaatcaaatgcgtatccactttcagcagattacgaattaaattgatggcttccagaggccgcacgctaaggtgatccagcgcctttaacatcaagtttccgagattatgaccggaaagttcgccattgccaccaaaacggtattcaaacatcgcggaggcgacgctcggttccgttatcagctggttgaggcagttgcgcatatcgccccaggcaatgccgccttctgaacggcgaatacgccccgtcgagccaccattatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcggggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcataaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagactgggcaccgaaaaagtgcgcctgacaggaggagagccgtctttacgccgcgactttaccgatatcatcgccgctgtgcgggaaaacgacgctatccgccagattgcggtcacaaccaatggttaccgtctggaacgcgatgtggcgagctggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgccatccagattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaagaaacagacccatttcctgcatcaaaacaacaccggtattacgcaaaacttatcgtacattggcggctaaaacgtcaaaaggagagatcagatgagtcaggtaagcactgaatttatcccgacccgtattgctattcttacggtttctaatcgtcgcggtgaagaagacgatacctccggtcactatctgcgcgattcggcgcaagaagcgggccatcacgttgtcgataaagccattgtgaaagaaaaccgctacgctattcgcgctcaggtatctgcgtggatcgccagcgacgatgtacaagtggtattgattacgggtggtactggcctgacggaaggtgatcaggctcccgaagcattgctgccgttgttcgaccgtgaagttgaaggttttggtgaagtgttccggatgttgtcgtttgaagagattggcacttccacgttgcaatctcgtgcggtagcgggcgtcgccaacaaaacgctgattttcgccatgccgggttcgaccaaagcgtgccgtaccgcatgggaaaatatcatcgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaagatggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaaacgctggtagttttttgttagccggataaggcaccgctgcgtccggcaatttcaccgctcagtacatacgtttacgctgcgtcgatgcacagcctcatcattttgcagtatccttaagatattccttatatcttcaggagatcgtcatggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgttcctgatgttgttgcggatcttcggcaaccgccgttaattctttttcaccatcactatcccggccatgtgtcgggatttttttcttactaaaaacgacacttaacaagtaccaggtataaaatatgccttatggacgagcggaagcgttttctgtatccataaatgcaaaagtattttgtatgcgtggttttaaatttattgatggtgaatattaatattttttctaaggataactaaaagaatggaatcatactcgcaaaacagcaataaattagattttcagcacgaggccaggatattaaacggtatatggctcattaccgctttaggtttggtggcaaccgcaggactagcctggggagctaagtatatcgaaattacggcaaccaaatatgattcaccaccaatgtatgtcgccatagggttattattactttgtatgtatggcttaagtaaggatatcaacaagataaatgccgccatcgcgggcgtaatatatctgtttttactctctttggtggcgattgtcgttgcaagtttagttcctgtatatgccattatcatcgtgttcagcactgcgggcgcgatgtttttaatcagtatgctggccggtttattatttaatgttgatcctggttctcaccgttttatcattatgatgacgttgacagggttggccctggtaatcatcgtgaatgcggcattaatgagtgaacggcccatttggataataagttgcttaatgattgtgttatggtcaggcattatctcgcatggacgaaataagctccttgaattggcggggaaatgccatagtgaagagttgtggagtccggttcgttgcgcttttacaggtgcattaacactctattactattttatcggcttctttgggatacttgccgcgatagctataacgcttgtctggcaaaggcatacgcgtttttttcattagccgtaaatgcacatactaaagaacttaactaaacttcacatcgccgcttcatttttcgcccgtagcttcttcgcctggctttccagcaacaggtaacagatcagcgccagcagcagtgggataaagtaatacagcacacggtaagcgagtagggcggcgataattgtacctttggaggtatgctccccagccagtagtgcgataaacaccgcttccagcacaccgatccccgccggaatatgcacgatgacgccagcaatactactaaccagtaacacgcccagtacaaagaaatagttcacgctttgaccaagtaacagccagataatcgcccccattaccatccagttaacgctggaaatcagcatctgagcgagggcgaatttccatgaaggcagcaccagcttttgccctttgatggtcatatggcggtgcttcgcgaaagcgcaaaaccacaaataaaccgcgataatcatcagtaagccaatgccgagaatacgcagcgtagtttgatcgacataccagtgatccggcaactccaccacgcctgcggtaaagataatccctgccagtaaaatgtagcccagccagttggtggtaatactgagcgagaaaatccgcgtaatagtgctaccgggcaaccccagacgagagtacaaacgatagcgcataccaatgccgccgacccaggtactgagcgtcaggttgaaggcgtagcagataaacgacaccagcatcacctggcgcttcgccagtttgtgaccgcagtaaaagcgggcgagcaggtcatagcagccgtaaatcagatagctgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggatcttctttgctaagcgccagcgcgggtgtgatttactcatcagggttttacccccgtgttttcagtttctacccgatcctgcgtttccattgtcggttgtgcgggcggatcaacctgcgccagacgtggcgtgtgtgccggaagccagccaaccagcgccgggaagtggcgtaaaaagtggaacgccagcacgcttttggtcaggttccaccaggtgcgtttgggcagcatggtttcatccacctgctgacaatctgcggcaataatgccgttcagattatcgcgcagcgtctggttaaaatgacgatcgtggatgatgacatttgcttcgagattcagtgacaaactgagcggatcgagattactggaccctactgtcgcccagtgatcgtccatcaatgccactttgccgtggagcgggcggcggcggtactcaaaaacctgaacgccgcctttaaccagatagttatacagcaagcgcgcaccgactctgacaatcggcatatccggttcgccctgaatgatcagtttgatccgcaccccgcgccgtgccgctttacgcaaggcgtgtaaaaatcgatagccggggaagaagtaggcgttggcgataatcacttcccgccgcgcctgagtgagcattttcaaataatggcgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggctatacgcgcgtcgatcaccacaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgcgctgctgccagtagtgccgcatgcagttgtttgccgacgtcatcctcaaaccagataaacgtttcaagaatgatgcgttcttgtgcctcgccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggcgcgctggcgctggcatttttgacgtagatcctgtccagtcgtagtagaggaaattgcaccggaaacgtgcgcgccgggcgtccgtgggcgcgggtaaaaatctcatccagtccggcctgcacttttaacggatgattagctttttgccgccagtcattgaaatcacccgccaccaataccggttcgccgtccggtagctcattcacccattcggcgagcatcgcaagctgcgcctgacggtgcgcctcacgcaggcccagatgtacgcacatcacatgaatcgcttttccggtcatcggcggcacaatgcggcagtagagcacgccgcgcttttccgcaccatcgaccgaaacatcgcgattctcataatgttcaatgggataacgcgacagtacggcgttgccgtgatgcccttccgggtatacggcattgcgaccgtaggcaaaatcgctccacatagtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgagtaagtagagataaattcttcaggagagaagccatgaagtggcaacaacgtgttcgtgtcgcaacgggtctaagttgctggcagattatgttgcatttactggtagtggcgctgctggtggtgggctggatgagtaagactctggttcacgtcggcgtgggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgtgctgtggctgttgtcccgcgttctggaaaacaactttttgctggcaattgcagggctggcaatccttgccggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcagccataccggcatgttttccaccggagaaacgtaaccggaaaggagaatggcgggcatcataaagacaaacacgccgataaacgcctgctgttgtgttgaacagagtgatgaaatcaacagaccgaatcccaccagcgataaaccataaatcaccatcgtaaagtagaacagcgccagcgatccggcgaaggggatttgatacgcccagataccaatcgccagcacaatggtggcctggaaggtggcgacaattaacgccggtacggctttgccgatgaagatctgccaggtggtgagcggcgaaaccagtagctgatcgagcgtaccttgttcacgttcgcgggcgacggaaagtgaagtgacgatcattacgccgatagtggtgatcatggcgatcagtgacggcaccacaaaccatttgtagtcgagattcgggttataccagttgcgtaccaccagctcgctgttgttaggtttcggttttccttccagcagctcctgctgataatttttgacgatctgttgcaggtagttggcggcaatttgcgcactgttggagttacgcccgtcgaggatcaactgcaaaggcgcggtctggaaggtatccagtttgcgcgagaagtcagccgggaaacgcaccagtagtaacgccttttgtgtgtcgatggttgggcggatctcctgtgggcttttcagcagcagcacatgagtaaaggcgctggcgcgggcaaaacgttgggtcagctccaccgaatgctcgccgttatcttcatcgtagatggcgatggtggcgttagtcacttccagcgtggcggcgaacgggaacaggatcacctgaattagcacgggtaaaatcagaatcgcgcgggtttgcggttcgcgcagcaacgactgcaactctttgcggattaacgtccataagcgatgaaacatgctcttctccctaatccagccgacgtttggttttcagccacgtcaggccgataaacatcaccgccgaagcgatcaaaaacagcacgtttaccaccagcaccactggaatattcccggcgaggaacaggctttgcagggtgctgacgaaataacgagcgggaataatgtacgtcaccgcgcggatcaccgcgggcatactgtcgatctgaaaaataaagccggaaagcataatcgacggcagaaaagcggcgttcagggcgacctgagcggcattgaactggttgcgggtaatcgtggaaatcagcagccccatccccagggtactgagtaaaaacaggctggagataaaaaacagaatcagcagcgacccgcgatacggcacgccgagaataaacactgacaccagcatacacagcaacatcgccagcatcccgagaaagtaataagggatcagcttacacagcagcagttccgtgcgggtaatctccgtagagagcagagcctccatggtgccgcgttcccattctcgcgccaccaccagcgaggtgagaatcgcgccgatgaccgtcatgataatggtcaccgcaccggggataatgaagtgctggctaatcgccgccgggttaaaccagtagcgggtttgtacatcaataagcggttcaaaagtctgcccgttgtcctccgctcgctgcatttgccagatctgccagatcccttcgacatacccctgtacaaagttagcggtattcggctcactgccgtcggtgatcacctgaatcggtgcggtggcgttggcgcgctccatctgttccgcaaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaacgcacagcgcccgtacgcgacgccaggacaggatcgggttactcattgctatgctccttatcccagtcgtggatcaactgaataaaggcttgctccatggtgggatcgggttgctcatcgttagccgactgtgctttcaaatcgtccggcgtgccgctggcgattaatttcccgcggtacaccaggccgatgcggtcgcaatattccgcttcatccataaagtgggtggtgaccatcaccgtgacgcctttctctaccatgctgttgatgtgcagccaaaattcacggcgggtgagggggtcaacgccggaagtcggttcgtcgagaaacagaatgtccggttcatgcatcagcgaacaggccagcgccagccgctgtttaaaacctaatggcagttcatcggtggcgtgggaggcgatacttttcaggccgaacgcctcgctcatgcgggagattttttcgttctgcgcccgaccgcgtaagccatacacaccagagaaaaagcgtaaattctgttcgaccgtcaggttaccgtagagcgaaaatttttgcgccatatagccgagatgctggcgcgctttaccggaactctctttcagatccatccccagcaccagcgcctggccggaagtcggcaccagcaaaccgcacatcatcttaaaggtggtcgatttacccgcgccgtttggccccagcaaaccaaaaatctccccacgtttaacggcaaagttgacgtgatcggtggcggcaaaatccccaaatttcttggtcagttctttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgttgatttccggcatcccgtcggcatggcgaatatcgtctggtgtggcctcttttttgaggatcagacgtaccgatttcccctgaatcatgccgtcgctgacctgcggcagtttcaaggcgcgttgcaacagtttgcggttgccctcgtgtggactggtcatcagaaagctgcgtccggccatggtttgtgtcagggcttttggttctccctgatacagcaactcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcccaccagggtacaggccagaccgagtttttgtttcatcccaccggagagcttgcccgccaggcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatataaccgagcacggcgtgcagcgcgccgtcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggcgcgacggcgggcttgtccatgcccggaaagcgtttttccaggccgttcagcgtgataacggcatcattcatgtcctgcctcgtcaccgaattgtaccgtcactggcattccctggcgtaacgcatcatcggcgtcggtcaccacaatacgcaggcgatagacgaggtcggtacgcagatccggcgtttcgacggttttcggggtaaattcagcagtcggcgaaacgaaaccaatctgcccgtgatacggcttgtccgggcgaccatcggtataaagcagcactttgcgccccggctgggcctggtcaagattacgttcatcaacataagcgcgcacccacaccggacgcgttagtgaaacggtaaacaccgtgccaccttcattgaggaccgtgcctggctccaccgcgcgcgttaacagcgtgccatcagacggggctatcaacgttgagtcctgtaaattcaactccgcctgcgccagttgcgcctgcgcctgttcgaggctggctttcgcctgagcgatgtcctgttcacggttaccggaacggtactgacgcaatttatcctgtgctgatttcagcgttgcctgcgcctggtcgcgcgaggagcgggcattttccaggtcatttgccgaaatagtgcggcttttccacaacccttgctggcggttatagaagttctgcgcatagtcataggcggcttgcgcctgtttcaccgctgcggcggcctgagcgatttcttcattgcgatacccggcaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgcgccccccaacacggaaactaagatttaccgtacgaatatccacgttgccatacagcgtcaggccgttatcctggcggctttgataccaccagtagcctccggcaaccacggcggcaagtaccactaccgccaatccgatcacgacaggttttttcatcactacaaactcctttgcgataatccttgcaaaatcaggtcgatatgacaggtcaccgtctggttgatcagttcggtcttttcttcatcgaacgcggtccagccggtacgtaacagaattgtttctttgccaagacggaacgccagaatctcaccaatcaacgcatgggtatgaaggatcatgcgggtgtcattggcgtcgcagccggtccaggcggcaatcaggcgtgtcaggtggctgtgtagcggactaatcacctgttcgtgcaccaggtggtaggctgccgtgggagagagctgctcacgggagataaacttgctgaggttgacggtgtcatcctgggtgagcagcttaatcatgttcctgcaggcgcgaaggatcagttcacggatggcagcccgatcaggctgtggttgcgcgaacaagcgttcggcttcctcggcatgcggacggaactgctcgccaataaaatcggcaatccactgggcgcaggcgaggtacaaatcttctttcgaaccgaagtagtaggtgatggcagcgatattctgcccggcctgggcggctatctcgcgagtggtggcgttcattccatattcaccaaactgcgccagtgcggcagcaatcagctgttttttcgcctgttcacccttgattgtcatggcaggattattcatcgcacagtccattcttaatcaaatgattgattaagattatgactccataggggagttgtccagtatggctaagaattttagcaacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaatcttttatgccgggctatgcccggcatcaggctgatgaacaaacgcaaaactgcctgatgcgctacgcttatcaggcctacgtgaactctgcaatatattgaatttgcatgcttttgtaggccggataaggcgtttacgccgcatccggcatttcacaacaagcacttgtcagcaatttgagaacacgggaaaaaatttatctgttttaccgcccataagccaccgagacgttacttctctatagccaattgttcgcgcaactccattaaaaggtagcccagtcgattcttgcccttaccatgaccaccgtctccccagtaagcatcgttttccgtatgctcaaccagttttgcgggcgcggttgccagcaagagcgcacgcagttctgcatgctgttcgaatttagcgcgaagtgcttttcgcatcacctgttctttgaccgactcccagtttttacgcagaggcttagaacgatcgcgccccatgcgtgcggcgaccataggggaagaaacccgacggatctcttcgcggtatttttcatcaaggaatttttgtgcctgaaaatagtgttctgaggtaggccaggttttcccgtcaaccttgatgggccaggcggcaaagttagaaaaatcaccgtagtcatcgctggtgctgtagaaatttatgatggtgtcttgcatgacgtgttggatcctttgtgctcgaacgggcattaaaccgcattatgttggtggttattgcgagccgctttccagaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgaacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttaccgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgctcatatgctcaatggtgaagtccctgaccttgagttgggcggcgtattgattgcgctgcgtatcaaaggagaaggggaagcagagatgctcggcttttacgaagccatgcaaaatcacaccatcaagctgacgccgccagcaggcaagccgatgccgattgtcatccccagttacaacggcgcgcgtaaacaggccaacctgacgccgttgttggcgattctcctgcacaaactcggttttcctgtggtggttcacggggttagcgaagatccaacccgcgtgctgactgaaaccatttttgaattgatgggtattacgccaacgttgcacggcgggcaggcgcaggcgaagctcgacgaacatcaaccggtgtttatgccagtcggcgcgttttgcccgccgctggaaaaacaactggcgatgcgctggcggatgggcgtgcgtaacagtgcacataccctggcgaaactggcgacgccatttgccgaaggtgaggcgctgcgtctttccagcgtttcgcatccggaatacattggacgcgtcgcgaagttctttagcgatatcggcgggcgggcgctactaatgcatggtactgaaggtgaagtgtatgctaatccgcagcgctgcccgcagatcaatctcattgaccgtgaagggatgcgggtgctgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctggtggctacgggtgaagcggcaactatcagcgacggcctggcgcgcgttaatcaggcattttaattcttttctcagccggatgagccatgtcatccggcttttaccccaccgcaatatgaaattcctgcatctttattgaccttcccacgcccggcgtgcagcataaaaatacaacaaacacataacataaacaggagttaaccatggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaaaaaaaagcccgtccagtggcggacgggcaaacaagggtaacataggatcaatgagggttagagcatatgcgtctgtcggcaaacagacagggaaatacttgtgctggacgtagcgtaaacgcctgatccgtccaacggttcggattttgtaggcctgataagacgcggtagcgtcgcatcaggcatctgttgccggatgcggcgtaaacgccttatccgtcctacgaattacttataaattaccgcagtaccgcttaatttattgttgttggtggcggaagtgatgctgtatccactggcaccggctgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacctactgataaaccatttatttgttgtacttatgaacttgttttataccgcgtggcagtcacagcagcgttaaaggcacggaatgacacgcaaaatacaaattatactcgctatgcatctcgccagttgtagttaacgtaactggctgtctttcgaacctctgcgattatatcctgtataagctggtttttgtaaatctttctcctgctgacaatgaatacataagcgcacgccaggaatggcttcccgacgggcctgcgggatgggggcaccgcactcttcacattcatccaggctttcgccgcgcggaatttcaccccgagcgcgggcaatcgcatcttcaattgtactgttgatctgttcgttgacggcgtcatcgttagcccaaccggatgccatatcgacctccccatatcaatacttgtacagttaagtgtagctaatccagggacgaactcgggcagttcaagcatcagatctccgaccattcccgcagcagattatgataaagattaagcagcgacaggatctcttcactttcgccgtagcggcttttcagcgactgaatattgttgtccagttcaaacagcatggcgcgctttttatcatcgcggatcatcgactggatccacataaatgatgccactcgtacgccgcgggttacgggtgtcacgcaatgcaggctgctggagggatacaacacgagatcgcctgccgggagttttacccgatgttgtccgaaggtgtcattaacgaccagttcgccgccgtcgtagctttgtggatcgcttaaaaacagcgtggcagaaaggtcagtacgcatccagccgttttgtggatggctgcgtactgcgccatccacatggaaaccataggtttcattgttctgatagcgattaaacagcggcgtggaaagggtacgcggcaaggccgcggcaaagaataaagcatgttggttaaccgcgttcagcacctcattttgcagggcggcgtataacgtgctgcgggtgtcgacctgttgattgttcttaacttgcgcaccttgtgcgccggtggtgacgcgtccatccacccattcggcttgttccagttgttcgcgaaaacgagcgacgtcctgtggcgataacacgccgggaatgtggtacatcatacaatttctccaaaaagtggggcctgcgccccacatctgaatcagaaatgcatattggctgtgagcaagaaggttcttggctcgcccgggtgataacggtagccgctcttgttgattgaggcgacgtaatcggtatcaaacaggttgtaaacgtttagctggaagtcgagattgcgattaactcgataccccagtttggcatcggcgacccagtaaccttcggtaaacgctggcgttcccaccgcgccgtctgaacctttatgcatactgccgatatagcgtgcgcccgcgccaacagagatatcgtcggttgcctgatattggctccataaggtgaaggcgtgctccggggtatacggcagcgatgaggaaccatcctgggcaacatctttgccgtttttgatggttgctttttgctgggtatagccgccaatcacctgccacgcgggagtgatattcccggccacggatatctcatagccttcgacgcgtttcttaccgtattgcgagtaagttccgtcatcattttgctcaacttcattttcgatatcagtgcggaacagcgcggcggtgagcaacagacgtttatccagaacctgccatttggtgccaatctcgctggtgttggctttttgcggtttaaaatcggtgcggttggcactgttaccgctgccagactgcgcaagggcgaagttgttgccgcccggaggctgctgggaaacggcatagttaatatagacattgccgttttccgtcaggtgatacagcgccccggctttccagttcatcagattgcccgacttggcggtgtcgacggtggtgaccggagaaccttttgccacaccagttgggcaggtgatggcaccgcgtccgctgccgccgcaggcggtggcactgtcatattcagtatgataattatccagacggatcccgccgttcagctcaaaatcacgggtgatttgcagcgtatcaaaggcgtaaattgcgaaggtatccgtctgaccattggcgtttgcgccgttgcgcgtcaggccgccgggatgaatgctgctgtcaggatgataaatatttaccgcgggtaacgtcaccggattaacgccgtagttagtctgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgccccgcccataatcgccgtcatcaggtaatcctgctttacgcgcgaccaacgggtagtattgcgaatggtggtgttatcgttgatgtcgtgctcaaaacgcatggtggcggtgtcggtggtcgaatcgtcgtaatcggaatccgtgccgtaaaagttatgagtatcaacttttccggaatgattcagggccgccgttcccgcagatggggcagaatagcccggcaaaccgatggtcggaatgccgccgtctggcgtgttgtgctgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcggtggtatcaccaatgacctgattgacgtccagcgtgccgcggcggaaccaggcgctgccaatactggcggaggcgtcaatgccggaatcattgcgcggctgcttgctgatcatattgatcgagcctgtcggtgcgctgcgcccgtagtcggtgccggacggccctttaatcacttcgacctgctcggtattgaaggtgtcgcgcgagacgctgccgatatcgcgaatgccatcaatataaatactgttagaggtatcggcaccacgcatataaatggcgtcgccagtggtggagttaccgttctcacccgcaaaaaacgcacccacgccggggacgtttttgagcgcgtcggtaaggttggttgcgccctgatctttaatcacttgttcagaaattaccgtcatcgtgcgggtagtatccgctaccggacgcgagaatttcggatcggcagattgttgtggcgcataaagcgaaggcgttgatgcttcgacaaccagcgtgtcatccgcgttagtttgcccttcggcggcgagtgcctgagccacaggcgtgatgccaatacaaagaccggcaaagaacgtgagcgaatgaaattgtctggcagggaaattgcgattgttttccattttgcaggtgactttttcttatatgttgaaattttcactgccacgagaaagcctctctgcggatgcgatgccactgttaatcccgtgatagtgctcgtgaaagtgataataattttgataagcattatcacttggagcgattttctatcacccattgcgcgaaaaagaaatacatttatttacattgagttcatatttgatgttttttgattacaaaacagacgaaaactgcatccagaggcgaatgcagttacgttggtggggttatttgtagatggttgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagctgaccgctgtccaggttactcatcggttgcgcggcataagccgtgagagagattccgctcaggacggtggcaatcagtagtgtgaggcactttttcataatgacatcctcataaatacaacgggtagtgcctgataagtgtaggtcgcctgcgcgatgcaaatgacgcaaaaaattgacagagatgtgcttattttttgaacgatatatttttacaaaataagacaaatcaatgacatgcataatgctgatttttatgatgaattgccataaaccatagccatgttaaggttttggggaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatccccgacggttttctctgcccaccagtaccgggccgggcggattatattcatcaccttgccgatttactggcagaagcaagcggaacaattccagcgaatgccagcattctggatatcggcgttggtgcgaactgtatttatccgctgattggcgtacatgaatatggctggcgttttaccggtagtgaaaccagcagccaggcgttaagcagtgcgcaggcgattatcagttctaatccggggcttaaccgcgccattcgtctgcgtcggcaaaaagagagtggggcgatttttaacggcatcatccataaaaacgagcaatacgacgcgaccttgtgtaacccgccattccacgattccgccgctgcggcacgggcaggtagtgagcgtaaacgccgtaacctggggctgaacaaagacgatgcactgaactttggcggccagcaacaggagttgtggtgtgaaggcggtgaagtcacctttatcaaaaagatgattgaagagagcaaaggcttcgcgaagcaggtgatgtggtttacatcactggtatctcgtggtgaaaacttaccgccgttgtatcgtgccctgacggacgtgggcgcggtgaaggtggttaaaaaagagatggcccaggggcaaaagcagagtcgctttattgcctggacctttatgaacgacgagcagcgccgccgttttgtcaatcgccagcgttaaagcgttggttcccccggcggtaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcataatttgccaccaccgaaccaatgccgcggacaaagttagcaaaggtggttatcgaagaccacggaatgatgtgatacgccccggtatcctgtcgtacgcccacggagcgaatcgacatccgttccactgtgccggtcaacggcccgatagtcaccaaatctccagtgttcatgccgttttcaaactgaataaataccccggtgataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacgaaacagcgtaagcagggtacgcgtgcgggcgctgggtagcgggcggccatgaatatccgaagccagccggttttcgatcaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcaacattaccgccacgcagactgtcagaatacgcgccgttttcagcgccgccgacagccagccattcaaccgtttttgcagctccggatagttacgctgagtatgtggcgagagagtgatggttttcgccagccagcgggaaaacataccggaaacaaacgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcgaagttgagcaaatgctgggtaatctcttttttattacgaaagatcaggtacaacgcccagacggtcatgcacagcataatgatgacgttcgccagcgcacctatctgtacattcacctgattagagataatcggcacggccacaatcaggccataacctatcaaactgcttaaccagctcaggcgacgactccagtaacgggcgctctcgtcctgaatcgtgaacgggcgcagctccgccacgtttgggcaaaaaatcaggcgtagtacggctttgaaaaattcaatgagggcaaaggcgttgagaaacaaactttgttggaaagcgatggtgcgactgcctgcattcaggttgtcgcttaatacctggccgacaaataatgtcagggccagtaacagcaggtcgataataaacgccccgataatcatcgccggaagctgcaaccagttgctgcgctcacgatttttttgccgcgcccactgacccattttgcgatacagcggcagtgcgcacaggcgaatcagccagtaaaaaccaaacactaataccgctaacattgaaaaatgggtcagcgcattgctgaaggtttgtggattaaacggcttatgcggggagccggtgatattgcgataaagttgcccgaagcgggcggaaagggcttcaccataatggcggctgacttcggtgaccttttgcagcacggtttgctcttcgaccagcgtcggcggcactatttttggtaccggttcagcagggggcgtagcggcaacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccagcaggcagaagaggatgaacaggatccaccgcatgactcctccagtgagaaaatagagcaaaaagataagtatagatgctggaggaggggcgattttaaatgagaggaatctggtgtgcctccctttcgggtgaaagggaggaagggatattaagcaggttgctgacaacgtgcgggcttttttgccggatgcggcgtgaacgccttatccgtcctacaagttcatgcaattttaataagttgccagatatcctgtaggcctgataagcgtagcgcatcaggcaatgtgtcttattaagagacgtgctgcaaaaattcctgcaagcgctggctcggcgggttcttgatcaacacctgcggattgccatcttccgcaatccggcctttgtcgataaagatcagccgcgaagctactttctcggcaaaaccgatttcgtgggtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccagcagctcacgtgccagtttttccgcctcttctttgttcgcgccacgcacgcgtagcgggccaaacatgacgttttccagcgctgtcagatgcgggaagaggtaaaactgctggaacaccatacctgcttcctggcgaatcaggcgctcgtcaactttcggatcgttaaccttcaggccatcgacaatcagatcgccggaggtgatttcttccagtttgttgatgcagcgcagcagggtcgatttaccggaaccggacggcccgataatcaccacgacttcgccctgggcaatgttcaaatcgatattgtgcagcacctgggttgggccaaagtgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgatcacaataaacagcgaggtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtggatagacagcaccgcaccacgcgtgatttccgcaatatacgcgccggagttgatcatgatggtgaccaccgccgcagtaaatgggtcgatgcgtaagtcgttaaacgccatcggcagggcgaaataaataaacatcacctggacgacgataggtgtgccgcggatcacttcaataaagaccagcgcgacgtggttggctatccaacctccgaaggtgcgtgcaaaacctgccagcaatccgattaccagaccgcctgccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccctcaccctaatcctctccccataggggagagggaactgccagtgcgttttacaggtgtagcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgcgcttccagagagtcacctaccgctttgaactgaccgttaccggcggttttgatgaagtacagaatgtttggcgtatcgtgcagaacggcgtctgcgcggttggtgcccagttccatataggcgttatcgatgttcgggaactgacgcagatctttagttttgatgtttgctttcgcgtaatcaacggagccagtaccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgccggaatgatcccactgaaatccatcggcttcagttcgtaatccagcttcagctctttagcgatggcagcccacagatcaacgtcaaagcccacatatttatcgccctgtttaaattcaaacggaacgaaggcggtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactccttgatttttcgagatgcggcaaaaacgtgatgcacgatttatagggcaataccctgaagatgcaccattctggggcaccaatctggtgcgctaaaattgtgcactcaacacagtgattatttagcgtaaaacctgatgaaaaaacaatctttatgtaacgattgtgtgatgatgtggatacaaaaaatttacttaatcagctggagatagcagatggatgcactaaataagtgcgttgaggtgggctgcaaaacaaaacggcctcctgtcaggaagccgcttttatcgggtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagttctttcaggtgatcctgaacgttgtggatgtccagcgggtaacttttcagcggggttttgctgttgataacttgagtggtccccagagctacaccgcccagctgcactgcacgttctgccatggtatccagatgatcgatcagtgcggtgcggaagccatccagcatttcatgtacggcaatgaagttagcgccgcgcatgttccagtgcgcttgtttggtaatcaaagaaagatcaataaactggataacctggcgattcagcaactctactgttgcttttttctcgctgtcggagacatcgttgcgggtataaagcagattggtcgcttttgatttaactaatttagcggtactcataatttcatatcctcttgatgttatgtcccagtaattaacgagattaagtatagcaccggctatgtgttccgctattctggctgttcctatcacactaatagtggtaacaagcgtgaaaaacaaaactaataaagattcaatgagttagatatattgataagaacaattcttatttatctgctcgccaggaattttcggaataaatatgcttttgcataattcgatatataaagacggtgtagaggaaaagtagcgagaaattctgcatggttatgcataaccatgcagaaatgtaaatttaattaatgtctaattcttttattttgctctctttgcgtactgtcagcgtagaccccattgaagcggcgatgatagcgccgagcgccagtagctgtatgggtgtcagtgtttctccgaggaaaatcatcccggaaacggcagccagcgccggttccatgctcatcagcgtaccaaatgtccgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcagggccatgttccgctcctgcgcgttgcccacttaaaatgtaaatagcccaacaagccccggcccccagtgccagcgcacagccggttaaatcgacatgggaaacgtcttgccccagcggtagcaggaaccacagaccaagaaccgccagcacaacccagacgaaatctaccgggcgacgagaagagaacagcgccaccgccagtggtccggtgaactccagcgccaccgcaatacccagcggtactgtctgaatagaaagataaaaaagataattcatcccacccagcgaaacgccgtaaaacaacagcggtaaccgttgctctttggcaaagcgcagtcgccatggcttaaagaacgcgatgaggatcagcgttcctaatgccagacgcagcgcagtgacacccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctagacttaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggcccgttagacatcacaaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgcgggtctgcagttcaacccgatggaaaacgttgctctggacttctcttacgagcagagccgtattcgtagcgttgacgtaggcacctggattgccggtgttggttaccgcttctaatcactttggtgatataaaaaatccgcctctcggggcggatttttgtttttaaggtttcgggtcgaaaatatcggttccgagatggttgtaatccaccttctgtaactggaagttggtgatgtatatcggcccggctttcttctcagatataaacgggtatttgatgttaatttccttcgctttaatccccgtccactgggagaaaaagcctaagaagtcattggctgagcggcgggctttaatcacacgatgcgctttatcgtcgctggaaatgaccataaaaggcacctggaaattttgctgatatttatcatcatgggcaaggtattgcacgtctttaccgcgctctttaaaggccagaccgtggtcagaaaagtaaaccagcgagaagctgctgccgctgttgcgtaactgatcgtacagcttgcgcagtaaatcgtccgtttgcgtcatggtatagagatagcacgacgtttctttcgattgcacaaaggtttcgtattttccttgtgtcctgtcgcaggcctgcggatgtgagcccatcagatgtagaacaatcagctgcggttgcgagtgctcttgcgccagcacttgagcggtcatatccagtaacgcttcgtctttggtgtttttatctgcttcaaaattaccttctttcaggaagtacacttcatctgctcgtttggcgatgctggcgatagcggtatcgtattcgccgatttgaccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttcaccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagcgcaaaaataaataagccgaccaggtagctgtaccacggaaaaatcgtcaggatttcggtcgactcttccatattggtggagtgcaatgccagcaatgtattgaaattaggcgcgccgtaggcctgagcaaaagggaaataacaagccgccaccagcgaactgacaccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagagtggaaaggggtccgcatccgcgagccgcaatatacgcagggctgcaagaagatagagcgagccgccgttcaggtcaactactgacgaacaaatcttttgcgaaggggattgcaaatccgacaaaaagtggggtttttcagaccaaaacgcgttatgcctgcatgaaagcaggagtgaagcggcgtaccgcgacgccgctatttatcggaaggtttatcttgctgcggtttgttgttgaccatatcgcacaacatagagagcagcattaaccgtactttaaagggagaatgactaaacacgcgcatacacctcttgaactcattcataagacctcctgacttgctaatcccgtcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagcttattgatgattacgttgagctgatttctgacttgatcagggaagtgggggaagctcgtcaggtggacatggctgctcgtctgggagtttcgcaaccgacggtggctaaaatgcttaagcggctggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggcatggagcaccatgttagtgaagagacgctcgacgcttttcgtttgtttacccagaaacacggtgccaaatgagcctgccttttttacgcacgctgcaaggcgatcgtttttttcagttattaattcttgttggtatcggattaagctttttcgtgccctttgcaccgaaatcctggcctgctgctatcgactggcacaccatcatcaccttaagcggcctgatgctgctgaccaaaggtgtggagttaagcggttattttgatgtgctggggcgcaaaatggtgcgccgctttgctacggagcgtcggctggcgatgtttatggtgctggcggcggcgctgctttctacctttctgaccaacgatgtcgcgctgtttattgttgttccgctgactatcacgctaaaaagactgtgtgagatcccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacgctcctgctcctgtgctggtgttgtttccctggaaaggcgatgcaataccatacgggggtgcaaacaccggagtggaaaccgcggctggtgtggagttgtctggggctgtatatcgtctttctgacggcgctggagttcaaacaagagctgtggggactggtgattgtggcggcaggctttgcgctgctggcacgtcgcgtggtgctcagtgtggactggacgctgctgctggtgtttatggcgatgtttatcgacgtccatttactgacccagcttccagcgttgcaaggcgtgttgggtaacgtgagtcatctatctgaacccgggttatggttaacggcaatcggtttatcgcaggtgatcagtaacgtgccgagtaccatattgttgctgaactatgtgccgccgtctttattactggtatgggcggtaaacgtaggtggctttgggttattacccggatcgctggcaaatttgattgcgctacgtatggcgaacgatcgccgcatctggtggcgtttccatctctattcaataccgatgctgttgtgggcggcgttggtgggatatgttttgttagttatactcccggccaactagggtctggcaaataaaaaaggcggattatgagtccgccttttgctttaagttttgaagattaattcagacgaaccggcatcccggagcggtttttaatcgcttcatcaagaacaacctggtcaacatctggctgaccggtcactgtctgcacgctcttcgtcagggtaattggcacaatttcctgaccttcaaactgggcttcggtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcatacaggcgaccgatatagagtgcatacagccccatcgggttatccggacctgccggaacgacagccggaagcggttcgcccgcagcgcggtactctgcgtgcattttggcggtcggcgtccaggtcgggcctgcttttttacgctcaactttggtggtccagttgataggcgtatctttgcctaactgaccaatgccgatcggcagcacgataacggtgttggtccctttcggatagtaataaagacgcatctcagcactgttaatgacgatgccttcatgaacggtatccggcaggatcagctgctgcggaatgttcagtacagtaccgcctttcggcaggaaggtatccacacccgggttcgcttccatcatattggaaagccccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgaccttgagccgacgctgggtaacgtttccctcgatcccaacgagcgcattggtaaactgcgtcaggatcagtttgcctttgaagagttcactgtgctggatacggtgatcatggggcataaagagttgtgggaagtgaagcaggagcgcgaccgcatctatgctttgccggaaatgagtgaagaagacggctataaagtggccgatctggaagttaaatacggcgaaatggacggttactctgcggaagctcgcgccggtgaactgttgcttggcgtgggaattccagtggaacagcactacggcccgatgagtgaagttgctcctggctggaagctgcgtgtgcttctggcgcaggcgctgtttgctgatccggatattctcctgctcgacgaaccgaccaacaacctcgacatcgacaccattcgctggctggaacaggtgctgaacgagcgtgacagcaccatgatcatcatctcgcacgaccgtcacttccttaacatggtctgtacccacatggcggatctggattacggcgagctgcgcgtttatccgggtaactacgatgagtacatgacggcggcgacccaggcgcgtgaacgtctgctggccgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgaccaaagggtttgataacggtccgctgtttaaaaatctcaacctgctgctggaagtgggtgaaaaactggcggtactgggtaccaacggcgtcggtaaatcaacgctgctgaaaacgctggtgggcgatctgcaaccggacagcggcaccgtaaaatggtctgagaacgcgcgcattggttactatgctcaggaccacgaatatgagtttgaaaatgatctgaccgtgttcgaatggatgagccagtggaagcaggaaggcgatgacgagcaggcggtacgcagtattctcggtcgtttgctgttcagccaggacgacatcaaaaagccagctaaagtgctttccggtggggaaaaagggcggatgctgtttggtaagttaatgatgcagaagccgaacattctgatcatggacgaaccgaccaaccacctggatatggaatccattgagtcgctgaacatggcactggaactgtatcagggcacgctgatctttgtttcacacgaccgtgagttcgtaagctccctggcgacccgcattctggaaatcaccccggaacgcgtgatcgactttagcggtaattacgaagattacctgcgtagtaaagggatcgagtaagtgattatccgtcaccccgatactgtcggggtgacggcggctgatgacaaatgcaaaatagcctgatgcgctacgcttatcaggcctacgcagtacctgcaatatattgaatctgcaggactttgtaggccggataaggcgttaacgccgcatcaggcattaacaaagcgcatttgtcagcaatctgagtaacgtcgaatcgattttcttaatcccacatcaattcacttccattaattctcaaacatccatgcccaacgctcgcttaccgtgaatgttgaggtcggcaagcgtaaagcgtccttcccagtttgtttcatagtcctcgcgcgggaagtcgcccggcgatgcgcctttttccagtgcggccttcaccttgtgcgcgtaggcaagatttttctcgcacatcggtgccgcaggaatgtacatcacgttgccccaaccttgttgattttcaacgggggcaacggaatggatgacgtcgcagtgccaccagacggagtctccggcttcgagttttggaatgctggttaacgcctcaatcaacagtggatgccattgctctgataccggcaatactcttccgggcgctacgccgcacagttcatcctccggcacatcatcaagcagcggacgtaacagtacgtacgccatagcttcaggaatgggcacgacgtgcagcagcccctgaccaggcagcatatcagagagcgctgtccagccctggaatgtccgaaacacggaacatttggtggtgttgtccaccgtgtactcttcaacttccgtacgatgtgccgcatgccagggatcatattgcgccagattgccattaaagacgttggcgaaaacgcgctgatacgctggaagcagccagcgttccagtgccccggagtcggtatgcgctccaagacctttggaggtcgttccgggcggacggcggcggatacggtcagggtagatgacgctcacatccgggttaaaccattgctttccatcactttcaaatgtccacagacgattgagaaacgactgcgcattcgccatttcttcactctggcgggcctgcatttgcgcctgcgaccagtagatggggtaaatctcgggacgtgaagcgctgagcgtcccgaagaaattatcgccggggcctttgtagacctcgtcaaagcggttgcggtccagatagtccagcatcgactgatcccagcctagcgcttgttcgcgggggaaatggccttttatcaccgcacaaccgcgacgtttaatctgttcgcgctgctctgcagtaacatgacctgctttgatatcggcataagacagcaccggccagacggcatcgccctgtgctttgagtgcgttgatttcagccactcgcgtggcaatgtcatcgcttagctgattaaagatctgctggacgtcgccaagctgcgcccgcagcgcgtgcttcatctgacggatagctgctttgtgatcggcaggcaatgtgtcgctggtaaaagtagaagccataaccacctctcattaactttcattcgaaaccattctgatttgcatgtgacaatataagttataaataagttaatgcaagtttaatgatttgatgtgatgtacaggatgtaaaaagaagggaaaaccggagcgcacggctccggtagagaggtcagctgttaaaaggggatgtgttatccagcaccgcctgaatcacattcagcgcgccttcatgattattatcatcggtagcgtaacgggcgatttgtttaatgttttccgcagcattgcccatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaggtcgataaagccaaaaccactggtaacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacaaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaatgaaataagctggtaatactgattaccgctggcaacaacgaacttaatgccgcgctttttcagttcctgatattgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagtaaggatgaaattgatgatgtgaatgatttagcccggcgacgacgccgccgggccgaggagattacagcatatgttcagtacgggcgatgatatcgtcctgagcgtctggagagagcgcggtgaagaacgcggaatagcccgcgacacgcactaccagatcgcgatactgatcgggatgttttttcgcatccagcagcgtttcgcgggaaacgatgttgtactgaatatgccagcctttatgcacttcaaagaaggtacgcagcaggatcatcagtttctgcttgtcagattcgttctccagcgttgccggattcagtttctggttgagcaacacgccgccgagaatcgctgccgtaggcagtttacccactgagccaatgaccgcagtagggccaagatggtcagtaccggaggccgggcttgcgccttctgccagcggggtgtgggctttacgcccgtccggtgttgccatagtctgcgcgccaaacggtacgttagcggagattgatgacgtacccgcgtaatagttgccgccaaccggaccacgaccgtagcgcggattatggtactgtttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatctgccagtgcggcagcaagctgttgctgaccaatcgcaccttgttcaaacaccagtttcttcactgccgccaggctgttgccgaggttggcaatgccgacctgcaggccagaaacccagtcatatttcgcgccgccttgcttgatacttttcgctcgctcaatacagtcatccaccagcgccgagcagagaatatcgtgcacgttctcttccagcatggtgtcgacgacatattcgatttcgattgatttgcgggtgtagtaacggatttgcgtatcccacgcgtccatcacttcatcgaagttgttgaagttacctgccgacaacgctttttcttgtggcaggaacactttgccgctggtggcatcatgcccgccttccagcgccgccagcatcacgcgggcgaagttgataaagctcatgccggtacagcgatagccccatttgccaccgacggcggtttctatacaaccaatcgctgcgtagtcataagcgtcctgcggttcaataccgagtttaataaattccgggatcacgatttcgtcgttgttgaacgccggcatcccgaagccgcaacggatcacctgtacgcaggcgtcgaggaaatcgttgctcattcctgcatggtaacgcacgctgaggttaggctgagtggaacgcaggcgaccgcaggattcgaggatcgcgtaagagagtggattcaccgcgtccattggttgaccatcaaccagattttgcccgccaatagtgacgttctgatacagcggacttcccgcagaggcttttgagtgtgagccggagcggatcttgttcacttccagcagtttcagccagcagctatgcagcatctcgatggcgtgttcgcgatccagcgtctggttgagttcaacgtcgcggcgatagtacgggtagagatactggtccatacgaccaaacgatactgagtgaccgttagattcgatctgcaaaatcaactggatgaagtaacacagttgcagcgcctgccagaaagtctgcggcggctggtgggcgataagatcgcagttttctgccatcgccagcagttcatcgcgacggctttcgcgggtttcggtcgcggccatttcacgcgccagggcagcgaaacgttcaatgtgttcactgactgccaccagcacgatatcaatcgctttcaggaattgctcaccgtgtaaatcttccagcaccgtcaggttgatgcgcgagcgacgttccgctacttcctcgcgcagaccatcaagccctttttccagcagcagcgggaaattcaccgccaggtgcgcatcgccggaggtcatattgccttccgctttaatgattccggtcgccagcagacctttttgctcatcggtaaacatgccgtagcagcgatcctgtacggtctgaccgcgccaccacgggcacacttcatgcagaacgcgtttgttctcttcgctcaccgcaaagccagcaccgggacgatctgccagatcatcaatctctttttcgatccacgagacagtatattccgggaagatcggcgcggcgcgaacttcgcttgcctggttgccaatgatcaactcatcgtgtttgatccagatggtgcgattcgccaggtgatgcgccagtgccagcgcgcgacgtaccgggatcggcttatcgagatgttgttgatacatctcggtatagtgctgcgcgcgctcggtacagactggcggtttcacaatatgcaccagcgcatttttgtgcgctttaatgcggtcgctgagcgtgtccagtttcagtgtggtcatggttgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagcgtgtggtagggcagaaaatgaatttcgccaacgtgcagctcgtcggcggcaaaatcggtaatggcttttacagaggtttcgtcggcattaaagccctgaatcagcggcacgcggataatgatttttttgcccgctgcggcgagttttttcaggttatccagcactctggcggcgttaccgtcggtccactgtttaaacggcgcgtcggcaacgtgttttaaatcggcaagaaacagatcgatatagggcagagaaggggcgatatatttccacggcacatgcagacaggtttctaccgcagtatgaatgcctgcctcgtggctggcttgcagtagcgccatcgccatttccggctgcataaagggctcaccacccgaaagcgttaaaccgccgccgctgcgatcgtaaaacggtttatcgcgcagaacggtcgtcatgatctcctcaacgcttttcacttcaccacacacggttaatgcctgtgtcggacagcagtcggttaacgccgtcagatgctccggggttaacttttcccgatgaataagcaaaccattcagcgcgcgctcaatcacttccggcgcggccttagcgcacagctcgcagccttccagacacagtcgtgcgtcatacagcagatcctgcgtgcgggcgcggctttccgggttctgacaccagcggcagcccagcgaacagcctttaagaaatacgaccgtgcggataccggggccatcatgggtcgagtagcgctgaatattgaaaatcatagttgcctctctatttcgttcaagcattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtgaccactaacccaagcattatcgccgcgggtaaaaaaccgctggatgttgtgcttccgcaacttcatgaagcgatgggcggtcaggggcgtctgtttgcccaggtaatggctaccactgccgaagggatggttaatgacgcgcttaagctgcgttctattattgcggatatcgtggtgaaagttccggtgaccgccgaggggctggcagctattaagatgttaaaagcggaagggattccgacgctgggaaccgcggtatatggcgcagcacaagggctgctgtcggcgctggcaggtgcggaatatgttgcgccttacgttaatcgtattgatgctcagggcggtagcggcattcagactgtgaccgacttacaccagttattgaaaatgcatgcgccgcaggcgaaagtgctggcagcgagtttcaaaaccccgcgtcaggcgctggactgcttactggcaggatgtgaatcaattactctgccactggatgtggcacaacagatgattagctatccggcggttgatgccgctgtggcgaagtttgagcaggactggcagggagcgtttggcagaacgtcgatttaaccggacgttctgcatcctcataaattgctgatgacgtggcggagtgccgcgtcttatcaggcctggaggtggcaattactgcccacacacctcacaccccggattacgcatcagtttcatttcgcgaaactgacaggtcatcgcatcgtacatgacgattttcccgctggccggtttgccataacctgccagcattttgatcgcttccattgcctgcaacgaaccaattacgccgatcaacggtgccattacgcctgcttccacgcaggttaatgcattttcaccaaacaaacggctaaggcagcgatagcacggttcaccgtcctgataagtaaagacggtgatttgaccttccatacgaattgccgcgccggaaaccagcggtaccttcgcggcaaaacagcctgcgttcagttgattacgtaccgcaacgttatccgtacagtcgagcaccagatcgtgttcagcaatcaatgctgcaagttctgcgtcatccagcagtgcattgactggcgtaatcgcgatatgtgggttgatccgcgtcagggcgtcacgggcggattccaccttcggttgcccgaccgtggcatcactgtgcagtgtctggcgttgcagattcgagagcgaaaccgtgtcgaagtcgagcagcgtcaggttaccgacaccggcgcttgccagatactgcgaggctgcacagccgaggccgcccaggcccactatcagcacgcgagaatctttcagcgcctcctggccgtcaaaatcaaagccgcgcagaatgatttgccggttgtagcgcagcatctcctgatcgctgagttccgccattacaggcctccgaacaacgcgttaaacggttctacttccacccattcgcccacttccacattgccgcgatcgcgttccagcacgataaagcagttgccgaggctaaaggagctaaatatatgtgaaccctgatgtccggtggtcgtcacttccagttcgccatcggcgttgcgttgcagcacgccgcgctggaaatcaagacgtcctggcgtttttttcaggcgggacgctgtgcgtacgcgctggcgcgcgggcaggccgctggcggtgttaccgcttagttttgccagcaaaggctgtaccagttgatagaaggtcagcgtcgctgaaaccgggttgcccggcaggccgcagaaccagctattgctgagtttaccgaacgcgaacggtttacctggtttaatcgccagcttccagaaggcgatctcccccagctcttcaagaatcgttttggtgtaatccgcctcacccactgaaacaccgccggaactgatcaccacatccgcctggctgtcggcttcaataaatgcggcgcgcagggcatggggatcgtcgcggataatccctaagttaattacctcgcatcccaactgttctaacatcaggtgtacggcgagacggttggtatcgtagatttggccgtcgcccagcggctgaccgggcaactggagttcatcaccggtagaaaaaagcgctacacgcactttacgaatcaccggaacttcggcaatccccagtgaagcaattactggcagctctgcggtagtcaggcgagttcccgccgggaaaacaaccgcacctgcagagatatcttcaccgcgacggcgaatattttgcccgctacgcacttcagcagtaaaacgcacgccattgtccatttgttcagtctgctcctgcatcaccaccgcttcgcagccttccggcaccggcgcaccggtcataatacgaatgcaggtacccgcaggccattcaccatggtatggctgaccggcaaaggatttaccggcaacgggcagcggttgcccggaggcaatatcggctaaacgcaccgcgtagccgtccattgcggagttatcaaaccccggaacatcaagcggcgaaacgacatcgctcgccagaatacgaccaaaacactgtaccagtggcagcgtttcctgggcggtcagtggggtgacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggcgtagcgctgggtcctgcctttacatgccatatccatctttctatattcaaaaattgaatgagtaattcataaaaattctgatatttatagcaaaagtggcgaaccacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccggctggtgatggagcaaagcccgcatgtgatgatgattggcgaaggggcagaaaattttgcgtttgctcgtggcatggagcgcgtctcgccggagattttctccacgtctttgcgttatgaacaactactggcagcgcgcaaggaaggggcaaccgtcctcgaccatagcggtgcgccactggatgaaaaacagaaaatgggcaccgtgggggccgtggcgttggatttagacggcaatttggcggcagccacgtccacaggcggaatgaccaataaattacccggacgagttggcgatagtcccttagtgggtgccggatgctacgccaataacgccagtgtggcggtttcttgtaccggcacgggcgaagtcttcatccgcgcgctggcggcatatgacatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtaatgtgctggcggttgaaaatctgaatattgcctttatgcaggaccagcagaaaatagctgcggtccgcaatctctcttttagtctgcaacgcggtgagacgctggcaattgttggcgaatccggctccggtaagtcagtgactgcgttggcattgatgcgcctgttggaacaggcgggcggtttagtacagtgcgataaaatgctgttgcagcggcgcagtcgcgaagtgattgaacttagcgagcagaacgctgcacaaatgcgccatgttcgcggtgcggatatggcgatgatatttcaggagccgatgacatcgctgaacccggtatttactgtgggtgaacagattgccgaatcaattcgtctgcatcagaacgccagtcgtgaagaagcgatggtcgaggcgaagcggatgctggatcaggtacgcattcctgaggcacaaaccattctttcacgttatccgcatcaactctctggcgggatgcgccagcgagtgatgattgcgatggcgctgtcatgccgcccggcggtgctgattgccgatgagccaaccaccgcgctggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgcgatgaaagggttagattatccccgacgtttcccgttgatatcgcttgaacatccagcgaaacaggccccccccatcgagcagaaaacggtggtggatggcgaacctgttttacgagtgcgtaatcttgtcacccgtttccctttgcgcagcggtttgttgaatcgcgtaacgcgggaagtgcatgccgttgagaaagtcagttttgatctctggcctggcgaaacgctatcgctggtgggcgagtctggcagcggtaaatccactaccgggcgggcgttgctgcgcctggtcgaatcgcagggcggcgaaattatctttaacggtcagcgaatcgataccttgtcacccggcaaacttcaggcattacgccgggatattcagtttatttttcaggacccttacgcttcgctggacccacgtcagaccatcggtgattcgattatcgaaccgctgcgtgtacacggtttattgccaggtaaagacgcggctgcacgcgttgcgtggttgctggagcgcgtgggcctgttacctgaacatgcctggcgttacccgcatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggcggtggtagagcggattagtcatcgtgtggcggtgatgtatctcgggcaaattgttgaaattggtccacggcgcgcggtcttcgaaaacccgcagcatccttatacgcgtaaattactggcggcagttccggtcgctgaaccgtcccgacaacgaccgcagcgtgtactgctgtcggacgatcttcccagcaatattcatctgcgtggcgaagaggtggcagccgtctcgttgcaatgcgtcgggccggggcattacgtcgcacaaccacaatcagaatacgcattcatgcgtagataacattcaggcggagaataaaatggcaagagctgtacaccgtagtgggttagtggcgctgggcattgcgacagcgttgatggcatcttgtgcattcgctgccaaagatgtggtggtggcggtaggatcgaatttcaccacgctcgatccgtatgacgcaaatgacacgttatctcaggccgtagcgaaatcgttttaccaggggctgttcggtctggataaagagatgaaactgaaaaacgtgctggcggagagttataccgtttccgatgacggcattacttacaccgtgaaattgcgggaaggcattaaattccaggatggcaccgatttcaacgccgcggcggtgaaagcgaatctggaccgggccagcgatccggcgaatcatcttaaacgctataacctgtataagaatattgctaaaacggaagcgatcgatccgacaacggtaaagattaccctcaaacagccgttctcagcgtttattaatattcttgcccatccggcgaccgcgatgatttcaccggcagcgctggaaaaatatggcaaggagattggtttttatccggtgggaaccggaccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccttacgagcaggccacactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgtccggcgctggtgaaagttgcctttgcgggctatgcaacgccagctactggtgtggtaccgccaagtatcgcctacgcgcaaagttataaaccgtggccttacgatccagtgaaagcgcgcgaattactgaaagaggcgggatatcccaacggtttcagtaccacgctgtggtcgtcacataaccacagcaccgcgcagaaagtgctgcaatttacccagcagcagttagcgcaggtcgggattaaagcccaggtgactgcgatggatgccggacagcgggcggcagaagttgaaggtaaagggcaaaaagagagcggcgtgcggatgttctacactggctggtcggcttcaaccggcgaagcggactgggcactatcgccgctgtttgcctcgcagaactggccaccgacgctgtttaataccgcgttttacagcaataaacaggtggatgacttcctggctcaggcactgaaaactaatgatccggcggaaaagacccgcttatataaggcggcgcaggatatcatctggcaagaatcgccgtggatcccgctggtggtagaaaaactggtgtcggcacacagtaaaaacctgaccggtttttggatcatgccagacaccggcttcagctttgaagacgcggatttgcaataagcaacgcagggagtggaatgcttaattacgttatcaaacgcttactggggttgattccgacgctgtttatcgtctcggtgctggtgtttttatttgtccatatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggttatatttggtatggcggcgggaattatcgccgccgtctggcgtaaccgttggccggatcgattgagtatgaccattgcggtgtcggggatctcgtttccggcatttgctctggggatgcttttaattcaggtattctccgttgaactgggctggctgcctaccgtgggagcagacagttggcagcactacattttaccctccctgacgctcggcgcggcagtggccgccgtgatggcgcgctttacccgcgcgtcgtttgtcgatgttttaagcgaagattatatgcgtaccgcgagggcgaaaggggtgagcgaaacctgggttgtcctcaaacacgggctacgtaacgcgatgatcccggtagtgaccatgatgggcttacagtttggctttttgctcggtggttccatcgttgtggagaaagttttcaactggccgggacttggacgcttactcgttgactccgtagaaatgcgtgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattattcgttattttattgattgtggtggccatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgctcgctggatattatgaaggctggtgggatcggctgatcatgcgcatttgcgatgtgctgtttgccttcccgggtattttactggcgatcgctgttgttgcggtgttgggaagcggcattgctaacgtgattattgcagtcgccattttttccatccccgcgtttgcccgcctggtgcgcggcaacacgctggtgttgaaacagcaaacctttattgagtcagcacgcagtattggtgccagcgatatgaccgttttgttgcgtcatatcctgcctgggaccgtctcttctatcgtggtgtttttcaccatgcgcattggtacctcgattatctctgccgccagcctctcatttctcggcctcggtgcgcagccgccgacaccagagtggggagcaatgctcaatgaggctcgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggacaatttttgcagcggcacagcgttcagatagttattttgttaaatgtattaacatgctgagtttatacgaaaagataaagataaggctgataattttatttttattggcagcactgtcatttattggtctttttttcatcattaactatcaactggtatcggagcgcgcggtaaaacgtgccgatagccgctttgaacttattcagaaaaacgttggctatttctttaaagatattgaacgttcggccctgacattaaaggactcactgtatttattaaaaaatacagaggagattcaacgcgccgtgattcttaaaatggaaatgatgccatttttagactcggtgggactggtacttgatgataataaatattatcttttttcgcggagggcgaatgataaaatcgttgtttatcatcaggaacaagtaaatggaccgcttgtcgacgagtcagggcgggttatttttgccgattttaacccatcgaaacgaccgtggtcggtggcttcagatgactctaacaacagctggaatccggcatacaattgctttgatcgtccgggtaaaaaatgtatctcttttacgctacacatcaacggcaaagatcacgatttgttagcggtggataaaattcatgtcgatttaaactggcgatatctgaacgagtatcttgatcaaatcagcgctaatgatgaagttctatttttgaaacaaggccatgagatcattgccaagaatcaactcgctcgtgaaaaactgattatttataatagcgaaggtaattataatattattgattctgtcgatactgaatatatcgaaaaaacatcagcggtgccaaacaacgcattattcgaaatctatttttattatcctggcggtaatttattgaacgcatcagataaacttttttatctgccgtttgcgttcattattatcgtattgctggtggtttatttaatgaccactcgtgtgttccgtcggcaattttctgaaatgacagagctggttaatacgctggcgtttttgcctgactcaacggatcaaatcgaggctctgaaaattcgtgaaggcgatgcgaaagagattatcagcatcaaaaattcgatcgcggaaatgaaagatgccgaaattgaacggtcaaataaattgctctcactgatctcttacgatcaggaaagtggttttattaaaaatatggcgattattgagtctaacaataatcagtatctggctgtggggatcatcaaactgtgtggtctggaagccgtggaagcggtgtttggtgttgatgagcgcaataaaatcgtcaggaaattgtgtcagcgaattgccgagaaatatgcgcaatgctgcgatatcgtgacattcaatgccgatctctatttacttctgtgtcgggaaaatgtacagacatttacccgtaaaatagcgatggtaaacgattttgacagcagctttggctaccgcaatctgcgcatccataagtctgccatttgtgaacctttgcagggggaaaacgcctggagttacgcagaaaaactgaaactggcgatttccagtatccgtgaccatatgttctcagagtttattttctgtgatgacgcgaaactcaacgaaatagaagagaatatctggattgcgcgtaatattcgccatgcaatggaaattggcgaactattcctcgtctatcaaccgatcgttgatattaacacccgcgccattctgggcgcggaggcgttgtgccgttgggtgtctgcggagcgggggatcatttcaccgctgaagttcattaccattgctgaagatatcgggtttatcaatgagctgggttatcagattattaaaacggcaatgggtgaattcagacattttagtcagcgtgcgtcgctgaaggatgatttcttactgcatattaatgtttcgccctggcagttaaacgaaccacactttcatgagcgttttaccaccatcatgaaagaaaatggcctgaaggcgaacagcctctgtgttgagatcactgaaaccgtgatcgagcgaattaatgaacatttttatctcaatattgaacaactgcgtaaacaaggggtacggatatcgattgatgactttggcaccggtttgtcaaacctgaaacgtttttatgaaattaatccagacagcataaaggtggactcgcaattcaccggcgatattttcggtactgcgggaaaaattgtgcgcattattttcgacctggcacgctataaccggatcccggtgattgcggaaggcgtagagagcgaagacgttgcgcgcgaattaatcaaattaggatgtgttcaggctcaggggtatctgtaccagaaacccatgccattctccgcctgggataaaagtggaaaattagtaaaagagtagtttacgtatgtccagaatcaataagttcgtacttacagtcagtctgctgatttttatcatgatttcagcagttgcctgcgggatctacactcaaatggtaaaggaacgggtgtatagcctgaaacagtccgttattgatactgcttttgcggtggcaaatattgctgaatatcggcgtagcgtggcaattgatcttatcaacacgctaaatcccacggaggaacagctgttggttggtttgcgcacagcttacgccgactcggtttccccctcttatttgtacgatgtcggtccttatctgatttccagtgacgaatgtattcaggtaaaggagttcgagaaaaattattgtgcagatattatgcaggttgtgaagtatcgacatgtcaaaaatacagggtttatctcttttgacggtaaaaccttcgtctattacctctatccggtaactcacaatcgtagtctgatatttttgcttggtctggagcgtttttctttactgtcaaaatcgctggcgatggacagcgagaacctgatgttctctctatttaagaacggtaaaccggtgaccggtgatgaatataatgctaaaaacgccatcttcaccgtttcggaagcgatggagcacttcgcctatttgccgaccggattgtatgtatttgcgtataaaaaagatgtttatttgcgggtttgtacattgattattttctttgccgcattggtggcagtgatatcgggtgccagttgcctctatctggtacgcagagtgattaatcgtggtattgtggagaaagaagccatcattaataaccattttgaacgcgtactggatggcgggcttttcttttcggctgccgatgtcaaaaaactctacagtatgtataactcggcgttcctggacgacctgaccaaagcaatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtctaccgcttcggcggtgacgaatttgcggtgatttatacgggtggaacgctggaagagttgctatcgattctaaaagaaatcgttcatttccaggtgggaagcattaatttaagtaccagtatcggtgtagcacattcaaatgaatgtcctaccgtcgaacgcttgaaaatgctggcggatgagcggctgtataagagtaagaaaaacggcagggcacagattagctggcagtaatcattattcgcaggccggacaaatgattttgcccggcctgaattaattaaacccggctaccccacaaatcgtactcatcggcgtgctcgactttcacacgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatctgctgctgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactgtttgatgcgcgccagttggcgatctacagaacccggacgcttcatcagtttgagaatgcgcgggctggcgtgctgcaacggaatgtccagatacggcaggattttgccttctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcaacgccataggcggaagtatcctgcgagatcaccagaatctctttaacgcccgcatctaccagacgtttcgcttcacttaacacttcgccaatcggacggctcaccaggtcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaataaccttgccgttttcattcaacgcttcaccaatggcttccagtgattcttgtaccgcgctgtcaataaagccgcaggtgttgacgatcaccatgtccgcatcgtcatagctcggtaccacgtcataaccttcagtgcggagttcggtgagaatacgctctgaatcaacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggaggcgaaggaaatgtaaattttgttaattcggcgtgaagaattgatcctggacagcattttgctcaaaaaatagccatactatttaattgcaacaaggctgggaagaggaggatcgaagtatgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagagtggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcggctcctgcaacggtaaatgtcgaagtactgcaagacaaactcgaccatccctgggcactggcctttttacccgataatcacggtatgttaatcactctgcgcggcggcgagttgcgtcactggcaagcaggaaaaggattatctgcgccgctttccggagttccggacgtttgggcgcacgggcagggcggcctgctggacgtggttttagcgcctgattttgctcagtctcgccgcatctggttaagttattccgaagttggcgatgatggcaaagccggaactgctgtgggttatggccgcttaagtgatgatctctcaaaagtgaccgacttccgcaccgtctttcgccagatgccaaaactgtctaccggcaaccattttggcgggcggctggtattcgacggtaaaggttatctttttattgctctgggcgaaaacaatcagcgcccgacggcgcaggatctggataaattacagggcaaactggtgcgtctgaccgaccagggcgaaatcccggatgataatccttttataaaggaatccggtgcgcgcgccgagatctggtcttatggcattcgtaatccgcaaggaatggcgatgaatccgtggagtaatgcactgtggctgaatgaacatggcccgcgcggtggtgatgaaattaatatcccgcaaaaaggcaaaaactacggctggccgctggcaacctggggaatcaactattcaggctttaagataccggaagcgaaaggggagatcgtcgccgggaccgagcaacctgttttttactggaaagattcgcccgctgtgagcggcatggccttctataacagcgataaattcccccagtggcagcaaaaattatttattggcgcgctgaaagataaagatgtcattgtgatgagcgtcaacggcgacaaagtgacagaagatggccgtattttaacggacagagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgccagagaaccattttacttttgccagttccgcatcgagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttccgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttagttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccaaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtctgatgaatggttatgccaaaaaactgggtctgaccaacactaccttccagacggtgcacggcctggatgcgccggggcagttcagcaccgcgcgcgatatggcattgctgggtaaagcattgatccacgatgtgccggaagagtacgccattcataaagagaaagagttcaccttcaacaaaattcgtcagcctaaccgtaaccgtctgctgtggagcagcaatctgaatgttgatggcatgaagacaggaaccacggcaggcgcgggatataatctggttgcttcggctacccagggcgatatgcgtttaatctccgtagtgttgggggcgaaaaccgaccgtatccgttttaatgagtctgagaaattattgacctggggtttccgcttctttgaaaccgtgacgccaattaaacctgatgccacctttgtgactcagcgcgtctggtttggtgataagagcgaagtgaatctcggggcaggtgaagcgggctcagtgaccataccgcgtgggcagctgaaaaacctgaaagcgagttatacgttaacggaaccgcagcttaccgcaccgctgaaaaaaggtcaggttgtcgggaccattgatttccagcttaacggtaaatccattgagcagcgtccgctgatcgtgatggaaaatgtggaagagggcggattctttggtcgggtgtgggatttcgtgatgatgaaattccatcagtggttcggcagctggttctcttaatcttctgataaccggatggcgcgaaacgtcatccggttatacgtcattaatacatcaacttaatgcgctgcgtctgcgcgtacttcacatactcatcttccgggcaacaatcgctcaccacaatatcaaagcgtttcaggtcacccatgcgcgccggacgcaccttgccaaatttactgtggtcgacaaccagcacatgcttttgcgccatcgacatggcccagtgttttaccggcaactcttcaagattaaaacaggtagcgcctttactgacatgcacgcccgccgcagaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaatcgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcactgcgcggttccagaacaatatagccgccgagcaaaacgacgggcgcactgtggttgttcagatcgcgacgaatcgtcatctccgaaaccccaagcagggcggcggcgtctttaagatgtaacttatcgctgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagacgcgataccacgattgcagacgttgatagagtttatgccccatcgcttgccagataatctgggcactaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgcttgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtaccacggccagcaacggcaccacggtaatcaaatctttagcaataaaaatcgccaacgagatcatccacggagccgagtctggcgtcgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtgggtgattgtaacgggcataggttaaataaaacttaaagaaagcgtagctatactcgtaataatgtaagaatgtgcttaaccgtggtttcagctacaaaattcgctttctcgttagctgcgcttttattaaactctgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgaccgcgtatctggcgggcgggatgtttttacaatggctgctggggccgctgtcggatcgtattggtcgccgtccggtgatgctggcgggagtggtgtggtttatcgtcacctgtctggcaatattgctggcgcaaaacattgaacaattcaccctgttgcgcttcttgcagggcataagcctctgtttcattggcgctgtgggatacgccgcaattcaggaatccttcgaagaggcggtttgtatcaagatcaccgcgctgatggcgaacgtggcgctgattgctccgctacttggtccgctggtgggcgcggcgtggatccatgtgctgccctgggaggggatgtttgttttgtttgccgcattggcagcgatctcctttttcggtctgcaacgagccatgcctgaaaccgccacgcgtataggcgagaaactgtcactgaaagaactcggtcgtgactataagctggtgctgaagaacggccgctttgtggcgggggcgctggcgctgggattcgttagtctgccgttgctggcgtggatcgcccagtcgccgattatcatcattaccggcgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctattggtcgctgctgcggcaacggttatctcatcgcacgcgtatttatggatgactgccgggttaagtatttatgctttcggtattggtctggcgaatgcgggactggtgcgattaaccctgtttgccagcgatatgagtaaaggtacggtttctgccgcgatgggaatgctgcaaatgctgatctttaccgttggtattgaaatcagcaaacatgcctggctgaacgggggcaacggactgtttaatctcttcaaccttgtcaacggaattttgtggctgtcgctgatggttatctttttaaaagataaacagatgggaaattctcacgaagggtaaaaaaatgcctgactgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgaccgcttgtggaacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcagccttcattcaggcattgtgttgccgggcgtgctgccggttttattggtcaaatggcgcttcgtgtttaagaactttatcgatcacatccagtacgccttcacggttattggagcctgcgcggtattttgccgctgcgacgaccgcgctaccggcattttccattgcaaaactaaagcctgcctgacgcagcatctcaatatcgttaccgccatcgccaaagaccaccacttcgctgtcgtctattccccataatttctgcagttggcgaaggccattggctttatgtacgccggggataatcagatcgatgctgccgttgccggtgtggaccgacaccataatatcgccgatggcctcatgtaatgctttttgtacttgtggaatcagttcatcggaaagattcaggccaaacttaaagaagatatcctctaagttgtcaaagttatcgacgtattccagacggtgataatacatttccgccaccgttttcatggcatcgtcatattttttgagtgtataggcactattttttccgcaggcaataatttccacttccgggcgcgtcagcaaatgttccacgacagtagcaaacgcatccttcgatagctcgccattaaaaacatctttgccttcgctcactacccagccgccgttttcagccacaaaggcaatttcattagcaatttcagggaagaaagagatcaactgataatattgattcccgctggcgactacaaagcgaattccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgttgctaccacactgacgcgggttggtgcatcggggccggtatcgctggcggcagaaatggtcagcgggaagcccagcgaggcacccagtccccagagtacaacagacaccccagcgacccaggcgctatcgacaaaaataatcagcccaatacccaacgcccccattagtgcactggcccgaaccacggcaacgcgactgtaacggtcgatgaaccaaccgccggtgaagcgtccaacggtcatccccagggtaaaaccggcataaatcagcgagccggaagtagggctaaaaccgtgaccgtcaaccattaataagggtaaccagtcgttggcagaaccttcggcaaaggccatcgccagcaccacaacacctatcagcagcaactggatatcgcgataaaaaggtacgcctttttcgccatgctgggtgccatcggcagcatttttgcccgtaccgtcagggattgcctgaatggcgatataaataggtgcgatacctaccagcgccgccaataaaatgtgcaccgttgccggaacgccaaaggccgtcagtgccatcccgacacctgcgcctgccagcgtgcccaggctataaaaaccgtgcatcatcggcaaaaccgtcttattcatttctcgctcaacggcagcaccttcaacgtttatcgccacttccgcagaaccaaaacttgccccaaagacgccgagaccaacggcaaagagcaggggcgatgtcagccagagtgccagacttaatatcatcatcccgatcaatgcgcaggacatcgtgaccaggatgacattacgtgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagatcacgtcaaaataagaagagggaagacaacattagcaaggttgtgtacatttgtacacaattgcagagagaggaaatgacatgcgtcgcgctaacgatccgcaacggcgagaaaaaattatccaggccacgctggaggcggtgaaactttacggaatacatgctgttacgcaccgcaaaattgctacccttgccggggtaccgttgggatcgatgacctactatttttcaggaattgatgagttgttactggaggcgttcagcagttttactgagatcatgtcccggcaatatcaggcattttttagcgatgttagtgatgctccgggcgcatgccaggctatcaccgatatgatctacagctcacaggttgcaacgccggataacatggagctgatgtaccagctctacgcgctggctagccgaaaaccgctattaaaaacggtaatgcaaaactggatgcagcgcagtcagcaaacgctcgaacaatggtttgaacccggaaccgcccgcgcgcttgatgcgtttattgaggggatgacgctgcattttgtcaccgaccgtaagccgctatcgcgcgaggagattttgaggatggttgagagggttgcagggtagtagataagttttagataacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtacgtgcgcccatcattgcgccgaacaacagcgcgcggttcattcgcaatacataagcaccgaacaagaaacagataaccacgggcaccagactgacaatcaatccggcaatcaacatctgaccgccaatcgcgcccaggccgttattaataccgctaccggcgctcagaccaacgcctgccataaacaccatcaagccgaactctttcaccatgcttaatgcaccctgcggaatgtaaccgaaggtcgggtggttagcacgcataaagcccagcataattccggcgaataacaacccggcagcgttccccatgccgaaactgaatgtgctgaactggaaggtgatcatcccgatcatcagcccaataacaaagaaggcgcagaatgccagcaggtcagtgacctggctgtgaatcgagataaagccgatgcgatcggcgatggtttttacgcggcgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttacctacagcgttatggtttttaacgaccacttcttcagtgacgatacgcatgtcgagaaggtcacgatcgaaaacttctttaccgttacggaagctgggatcgagtcgggcatgggcgtcgggatagcctaccaacgctatttcatcgcccatttgtagcacggcatcaccgtctggatttgccagaatcccgttacgtcgaatacgttcaatgtagcagccggtttgtcgataaatacccagttcacgcagatttttgccgtcggtccaggccaccagttccgggccgacgcgataggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagcctgctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacgccaatggaattacccagttggatcgaaccaagtcgtaactttccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaacgatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgcctttttctggcgacgcacatgaaaggcgcttttcgggctgccgggcatcctgaaatcggcttgctatttttcattcttcctggagcagtcgccagcttcttttcacagcgtagagaagtcctgaaacctctgtttggcgcaatgctggcggcaccctgttcgatgctcattatgcggctgtttttttcaccgacgcgctcattctggcaagagctggcatggttactaagcgcggtgttctggtgtgcgctgggggcactgtgtttcttatttatcagtagtttgtttaaaccacagcacagaaaaaatcagtaaagccctcaacgcgagggcttgtcagacgatcaggcgtccagattttctttcacccatgcagcaaaatcggtatagccgccgatatgttgctgatcgacaaaaatctgcggcacggtttctacgggtttacctgccttttgttgtagatcttctttagtgatcccttccgcacgaatatctacatactgatactgaaaatcatcgcgttcattgctcaatttctcagccagatcttttgcacgcacacagtaagggcaacccgaacgaccaaaaataacggtttgcattatttctctcctcatagatttatgcctgtaatgatcacgctaaaatgtattcgctgaaagtaggtttaacctgttgcattaattgctaaaagctataactgttaaacacaatacagtgaaaagttttagactgaaggctcactttgcagagggaagcgtatgcgcgcgatcggtaaattgcctaaaggcgtgttgatactggaatttatcggaatgatgctactggcggtggcgctgctgtcggtaagcgactccctgtcgctgcctgagccattttctcggccagaagtgcagattctgatgatttttctcggtgttttgctcatgcttcccgctgcggtggtggttattcttcaggtggcaaaacgtcttgccccacagctgatgaaccgtccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaaccgccacgtcgatgtatgatacgcgggcttttgaccaggtctgacagagaggtgcagggtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagttggttgaaggcacgcagggaattggcgtcgtgctggcggagacgcgtcaggcggcggaaagcgtgattgacgctttccgcggtctgaacgcgcatattctggtgcaggaatatatcaaagaggcgcaagggtgcgatatccgctgtctggttgttggcgatgaagtggtcgctgcgattgaacggcgggcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaggtgaatgcgtcgccggggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcgaaagaggttgtacaaaattatgacatcgctggtcgttcctggtctggatacgctgcgtcaatggctcgatgacctggggatgagtttttttgaatgtgataactgtcaggctctgcatctgccccatatgcagaatttcgacggtgtctttgatgccaaaatcgatctgatcgataacacgatcctgttttctgccatggcggaagtccgaccttcagccgtattgccgctggcggcggatttatctgccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgatgatgaagggcaaaacaacgttaccgaaaactatttcctccactgataactcctttcgagcacgcagtcgctggtgcagtggctgcgcgctgcaaaattatctgctgtttttaaccttttcttaaagattatttcacttctcttgtgtcgatttggctttatcacatagagcaaatatgcataaaaatttgttaaataccgttttttaatccgagctatagtctcaaaccctggctaaagttattcttgcgatgcttttatatagcgagcagtgctggccgggagaaagttctcttttcttacaccgcgccgataaaaaatatgcacgtttattgcatatctttcagtgtgacaacttttgttcgtttgttaacgaactttcagaaggaaagagatatgaccgccttaaataaaaaatggctatcgggtctggttgcgggtgctctgatggccgtctctgtcggcacgctcgcggctgaacaaaaaacactccacatttataactggtctgattatatcgccccggacacggtggccaattttgaaaaagaaaccggtattaaagtcgtctacgatgttttcgactctaacgaagtactggaaggcaaattaatggccgggagtaccggctttgatctggtggttccatctgccagctttctggagcgccagttgactgcgggagttttccagccgctggacaaaagcaaattgccggagtggaagaatctcgacccggaactgctgaagctggtcgccaaacacgatcccgacaataaatttgctatgccctatatgtgggcgacgaccgggattggctataacgttgataaagttaaagcggtgctgggcgaaaacgcgcccgtcgatagctgggacttgatcctcaaacctgaaaatctggaaaaactgaaaagctgcggtgtctctttcctggatgcgccagaagaagtttttgctaccgtgttgaattatctcggcaaagatcccaacagcactaaagcggatgattacaccggaccggcaacagatctgctgttaaagctgcgcccgaacattcgttatttccattcatctcaatacattaacgacctggcaaacggcgatatttgcgtcgctatcggctgggcaggtgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgcccggatgtagtagcgcatatttccgaccatgtgttctatgccaacgccaataaagcagccacgccgctggtgagtgcggaagtccgtgagaacccaggtatttatccgcctgcggatgttcgtgcgaagctgttcactctgaaagtgcaggatccgaaaatcgaccgtgtgcgcacccgcgcgtggaccaaagtgaagagcggaaaataatccgcagtcgtagatgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgattgtctttaaaataagcctggcggagatggcgcgcgctattccaccttataccgaactgatggagtgggctgacgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggctgggggttatcgatcaaccgctgaccattctgcataccaatctggccgtttatatcggcattgtttacgcttacgtgccgtttatggtactgccgatttataccgcgttgattcgtattgattattcgctggtggaagcagcgctggatctcggtgcacgaccgctgaaaacgttctttactgtgatcgtgccgctgactaaaggtgggattattgccggatcgatgctggtgtttatcccggctgtgggcgagtttgtgatcccggaactgctcggtggcccggacagcatcatgatcgggcgcgtgctatggcaagagtttttcaataaccgcgactggccggtggcctcggcggtagcgatcatcatgttgctgctgctaattgtgccgataatgtggttccacaaacaccagcaaaaaagcgtgggagaacacggatgaataatttaccggtagttcgttcgccctggcggattgtgattttgctgctgggctttacctttctctacgcgccaatgctgatgctggttatctattcgtttaacagctcgaagctggtgacggtgtgggccggctggtcaacgcgctggtatggtgagttattgcgcgatgacgcgatgatgagtgcggttggtttaagtctgacaattgcggcctgtgcggcgacggcggcggcgatcctcggaactattgcggcggtggtgctggtgcgctttggcaggtttcgcggatcaaatggctttgcctttatgatcaccgcgccgctggtaatgccagatgtcatcacgggcttgtcgctgttgttattattcgtcgcgcttgctcatgccattggctggcctgcggaccgcggtatgctcaccatctggctggcgcatgtcactttttgtacggcttatgtggcggtcgttatttcttcaagattgcgggaactggatcgctcgatagaagaagcagcgatggatctcggtgcgacgccgctgaaagtgtttttcgtcattacgctaccgatgatcatgcccgcgatcatttctggctggttactggcttttactttgtcgcttgatgatctggtgatcgccagctttgtttccgggccgggagccaccacgttaccgatgctggtcttttccagcgtgcggatgggggtgaatccggaaatcaacgccctggcaacattgatcctcggcgcggtcggaattgtcggatttatcgcctggtatctgatggctcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttaagcagtctggtgctggttttcattgagatctggtgtgcgttttcactggtgaaagggcgtcgctgggcgcgctggctatatctgctgacacaaatcaccgccgcaagttacttgtgggcggcttcgctggggtacggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataatgcagccgattccagagcaactctccgctaaaaccgccgatcttaaaaatctgctcgccgactttccggttgaggaatggtgcgcgccggtgtcaggcccggaacaagggtttcgtaataaagccaaaatggtggtgagtggtagcgttgaaaaaccactgctcggtatgctgcatcgcgatggcacaccagaagacctttgtgactgcccgctttatcctgcctcatttgcgcccgtttttgcggcgctaaaaccgtttatcgcccgagcggggttaacgccctacaacgtggcgcgtaagcgtggcgaactgaaatacattctgctgactgaaagccagagtgatggaggcatgatgctgcgctttgtactgcgttctgataccaagctggcgcaactgcgtaaggcgctgccgtggttacacgaacaactaccgcagctgaaagttattaccgtcaatattcagccggtacatatggcgattatggaaggggagacggagatctacctgaccgaacaacaggcactggcggagcgttttaatgacgtaccgctgtggatccgtccgcaaagtttcttccagactaatccggcggtcgccagccagttgtacgccaccgcgcgcgactgggtacgacagctgccggttaaacatatgtgggatctgttctgcggtgtggggggctttggtttacactgcgcgacgcctgacatgcagttaaccgggatcgaaattgcatcagaggccattgcctgtgcaaagcagtcagccgctgaactgggcttaacgcgtttgcaatttcaggcgctggactccactcagtttgccaccgctcagggggatgtgccggagctggtgctggttaacccgccgcgccgcggcattggtaaaccgctgtgtgattatctctcaacgatggcaccgcgttttatcatctactccagctgtaacgcccaaactatggcgaaagatatccgcgaactgcctgggtttcgtattgaacgggtgcagcttttcgatatgttcccgcataccgcgcactatgaagtgctgacgctgctggtgaagcaataaaaaagccgcatgtgcggcttcagattgctgacaaagtgcgcgttgtttatgccggatgcggcgtaaacgccttatccggcctacaaaagcgtgcaaattcaatacattgcatgggccatgtaggcctgataagcgtagcgcatcaggcaattttacctttgtcatcagtctcaagccgcggttgcggctttctgaatcttactgtgggaaccactggtcactgattttttgataagtaccgtcagctttaattgctgccagcgcgttattcagtttttccagcagggctttgttatccggacgtacagcgatgcccaggccggtgccaaaatattgcggatcggtcactttctcagtagcaacaccaagttgtggattggttttcagccattcgtttaccaccgctgtgtcaccaaataccccatcaatacgaccatttttcagatcgataaaggcattctgataactgtcataagagacagttttcacttccgggtgctgatcctgaatatatttctggtgcgtagtaccgttttccatcccaatacgtttgcctttcagatcggcaaacgttttgtaggtatcttttttggcaatcacgacggctgagttttcatagtagggcgtggtaaacgatacctgtttgctacgctccggggtgatatccataccggagattacggcgtcatattttctgaatttcagggacgggatcaggctgtcgaacgcgtgattagtaaaagtacattctgcctgcatttgtttgcacaaggcttttgccagatcgatatcaaagccgacaatctcattattagcacctatagattcaaagggtggataggtggctgaaacgccaaaattgattttctctgcggcagaagcaccgaaagtaaaggaagcaagtaaagcggcaagaactaactttttcatgatggaactcccgtctgtcaatcttatgatttttggccgtgtctgcggcatgggataacaatgccatcaagtgaatttatatgcaataaacatgattaaataatttaaatgaaataaaaaagacggacaacttagtgggttgtccgtcttcattataagaatttatgcactatgtaggccggataaggcgtccccgccgcatccggcacaggcaccgtgctgatgtctgatgcgacgctggcgcgtcttatcagacctacaaaaccccccggcgaatgtacgcagccacattaatttcgccgttcgaatgccagcgctttgcgctcgatcagacgcatcatcagcgtcagcaggccgttaacgaccaggtaaataatccctgccgcaccgaacaccattacatcgtaggtgcgtccgtacaacaactggctgtatcccatcacttccatcagcgtaatggtgtatgccagagaggtacttttgaataccagcaccacttcgttggaataagaagagagcgagcgtttaaaggcatacggcagcaggatcgccagcgtatcttttttgctcattcccagggcgctacaggactgccactgaccttccgggatcgcacgaattgcaccgtaaaacagctgcgtggtatacgccgcactattcagcgacaacgcaatcagcgcacataaccacggttctgacaacaaatgccacagtgccggatactcctgcaaagtcggaaactggcccggcccgtaataaatcaggaagatctgcaccagcagcggcgtaccggtaaacagcgtgatataaccccgcaccagccacaccagcaccggcgttttcagcgtcaggatgatggtaaaaatcaatgccagaatcagtgccacaatcagcgaggcaacggttagcgtcaggctggtgtgtagccctttcatcagttcgggtaaatactcaaacattagctgggcctccgctcaaaacgtgtcgcgcgcaggtcaatgcgtttgagaatgtactgactgagcagggtgatcaccaggtaaatcgccgccgccacaatgtaccaggtaaatggttcctgggtacgagtagcgatgctttttgtttgcagcattaaatcattcacactaatcaaactgaccagcgcggtatctttcagcagcaccagccactggttaccgaggccaggcagcgcatgacgccacatctgcggcatcaccagacggaaaaagatagccgatttcgacagccccagcgcctgaccagactcccactgacccaccggcaccgctttcaacgcgccccgaagcgtttgcgaggcataggcggcatacagcagtgacagagcgatgacaccacaaaggaacgggctaacgtcgaagttctcaatgtccatctgcactgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccattttgccgactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagctcagtgttgccctgacgtaccgcgatgccgaggccagtgccgaagtaatctttatcggtcactttgtcgcccaccgccgccagtttcgggttatctttcagccactcagtgaccactgcggtgtcaccgaagacgccgtcgatacgcccgttttgcagatccagttttgcgttctggtagctgtcatacggaacggtagtgatttccgggtgcttatccataatgaatttctggtgtgtcgtcccgttctgtacgccgacttttttgcctttcagctgatcaacactggtgtatttgccttgctgacccacaaacagggcagagttgtcatagtacggggtggtaaacagcacctgcttttcacgctccggagtgatatccatgcccgccatcacggcttctacgcgacggaatttcaggcttgggatcaggctgtcaaacgcctggttagagaaagtgcaggttgcatcaatctctttacacagcgcttgtgccaggtcgacgtcaaaaccaacgatctggttgtttgcatcaatcgattcaaacggaggataggaggcttcggtagcaaaacgaatggtttcggcagctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccattttccatatacaccactcggctggcggttttacgcgccacttcaacttcgtgggtgacgatcacctgggtaatattcgtttctgccagctcacgaatgatgctgacgatttgtgccgtaatttccgggtccagtgcggcggtcggttcatcgaacagcagtacctgcggttccatcatcaacgcacgggcaatagcaacacgctgctgctgaccaccagaaagatgcagcgggtaacgatcgctataaggtttgagacgcagacgttccagcagtttttctgcacgggccagcgcctgatctttactcaaccccagtacacggcagggcgcttcaatcaggttttgctgcacggtcagatgcggccacaggttgtattgctgaaacaccatgccaacgttacgacgcaaatcgcgaatcgctttgtcagagggtgttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagatagtacctttgacagaataattatgcaatatttctgctttaaaagttaaaagcaaagcgcattattcaataaacatagcacaaaataacgggggcggtggtcggcgagcataaatgtcggcattcctcacgaaatgccggacaatttacggggtttattggttgatcaaggcgttagcgattctcgatggactgacggagcgtacccgccgtggcatgaacgctaccgcctaagtaacgcacatcgtcgatgacccaacactggccttcctgaatcattaacacttcatcctgccaaccctggtcaccctgtttgagatccacgcgcaatggaatgttacgggcatcacgattagggatagtcgatgcactggcaacgtgggcgctatctggcaaggtggttcgactggagaatggatcgttggtcagtagttcccgatggttattatcccgggaggcatcgctaagcagtgtcgccagtttgtcgctcagataagggcgcaaggcggtgatgtcgttgctgcggtgcaaaatgcggtagtcataaaattgctgggccacgttatccgggcctccttcaacgcaaggaccactgcgtgtgccgttatctttataagctggagtgactgtggtgcaggcactgaggagcagtgcgcaggggataagcattgtcaatttgctgtagcgcataatgatttccttataagcgatcgctctgaaagcgttctacgataataatgatatcctttcaataatagcgtatcagtctgataatgcttttgagatcgaaggcttagcaaacaaggagatcgatcatgcaattttctacaaccccaactctggaaggccagaccatcgttgaatattgcggtgtggtgaccggcgaagcgattttaggtgccaatattttccgtgatttctttgccggtatccgcgatatcgttggcggacgttccggtgcgtatgaaaaagaactgcgtaaagcacgggagatcgcctttgaggaattaggctcccaggcgcgggcgctgggggccgatgccgtcgtcggtattgatatcgactacgaaacggtcgggcaaaacggcagtatgctgatggttagcgtcagcggtacggcggtgaaaacgcgtcgatgagaagattcttctggctggtcgctgccgctctgttattggcagggtgtgcaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtaccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggccggagtgaaatattttgccccgtttgaaccggcacagattcaggcgcttattccactggcgaaagatattattgcccgttatcacatcaagccggaaaacgtagtggcacatgcggatatcgcaccgcagcgcaaagacgatccggggccattatttccctggcagcaactggcgcagcaggggattggtgcctggccggatgcgcagcgggttaacttttaccttgccgggcgcgcgccgcacacaccggtagataccgcgtcattgctggagcttttggcgcgctacggttatgacgttaaacctgatatgacaccgcgcgagcagcggcgcgtgattatggcattccagatgcatttccgcccgacgttatataacggcgaagcggatgcagaaactcaggcgattgccgaagcattgctggagaaatacgggcaggattagcgcggcagttttccgtggtcgcgtagccaggcggcagttttctcgataccttcatccagggtgatgaccggctgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaggggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacattgcgtgcacggcattttcatagtaggtcatatcgaccagcgcactgccgccatgcggtaacagaatactgccgtagtggtgcatcatatgcgccagacggggaataaagactttatcgtgcggtccgaacagactttgtgggcgcagaatagtaaagcgcgtttgtggattcgcctgcgaaagcatattgatcacttcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggtgaggtaaagctggagcagtgccacagcgtatcaatgcccgcgagcatcactttagcttgtgatgaaaccagctcggtcagatccgccggaacaaactctgcgcccattttttccagcaatttgcccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcccccatgatgcaatgggaaacatgaaagaataacgcaggttttgtcgattaatctgtgctttgttctgccagtctggcgatttgttttgccattccgcgaaaaataaacagatgcgcggggatcatcaataaccagtaaaacagccccggcataccgtgcggatgccagaaagcgcggacatcgatagtacgatagtcgcctttatcttccaggctaaaacacagtcgtcccagccccggcgctttcatgccaaataacaacgtaagttgtttttccggttcaacgacaatcactttccagctatccaccgcatcgccagtctgtaaatattcgcgctccgggcggcctttcgccagcttatgaccgatcgcgcggtccatcaacgcccgtgtctgccacaaaatattgccaaagaaataacgctctttaccgccgatttggttcactacctgccataaagcagcaaggctggcggacgttttaacggtaaaccccgcctgtttggcaaaataaccgtactccggtcgccagcgggcaaaggcctgagcgtcgtagccccagtcgctggagttgaccagtttttcctcctctttcaacgtgctacgtaccgcgtcatcgaaagcgatcagccgttgtgggatgagtgcacgtagcgcggtatcatccgccagcagatcgtgtttcagcccctgaatcaacgccctggcggtggtgggcggtacggaagtaatcacattgagaaaccacaccgaaatccagcgggtggggagggggatggggatcaaccagcggcgcttaccgctcaccgccataaaatgttcaaactgttgctgataactgagcacctctggtccggcggcttcgaagatgcggtgttcgctggccggatgatctaacaacgcaaccagatagtgcagcaagttttccagcgcaatgggcgtggtgcgtgaacgaacccagcgcggaggcgttaagactggcaggttgtagaccatatcgcgcatgacttcgaacgccgcggaacctgcgccaacgataattccggcccgcagttcggtcacgggtacattcgcttcacgcagaatgtccgccgtagcctgacgagcacgcagatgatccgactgctcatgtggcggggcctgcaacgaactaagaaagattaattgcttaactggtacttcacgtagcgcatcgcggacgttgagagccacctggcgctcctgagcgataaaatcgccgccttcgcccatgctgtgcaccagaaaatagaccgtatcgatatcctgcaacagggccggtaggttatccggccagctgagatcgactttatggcaactgacgtttgccagttgcagctttgcaagcctgtcgacatgacgtgccgccgccaggatctgatgcccttgctggctgagtgtgcgcaccagatgctgaccaatgtagccactggcaccgagaactaaaatgcgttgcggcacgtctctctccttaacgcgccaggaatgcacgccagtgggcggcgacttccgccagttgttcgcgcgagacgtcaagatgcgtcaccaggcggacaatcggcgaggcgttaatcagcacgtttctcgctttcatgtattcgcctaacgcggcagcattttcttccccgacgcgaacaaacagcatattggtgtcctgacgcatcacatccgcgcctgcttcacgcagctgctccgccatccaggcagcgttgtcgtggtcttcctgcaagcgcgcaacgttatttttcagggcatatatcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgaatcacaatattgcgtgatctctttcagttcgcagccgtaagccaccacggcattaaagatgcgcgcaccgtcaacatgcagcgccagattgcgctcgcgggtaaattcccatgcttctttcaggtattcccgcggcaacactttgccgttgtgggtgttttccagactgagtaatttggtgcgggcgaaatggatatcgtcgggtttgattttcatcgccactttatccagcggtagcgtgccgtcggcagccgcgtctatgggttgcggttgaatactgcccagcaccgccgcgccaccggcttcaaacagatagttatgcgcggcctgaccgacaatatactcttcgccgcgttcgcagtgactgagcagagcgaccaggttggcctgagtgccggtaggcagaaaaatggcggcttctttaccggaaagctctgctgcgtagtcctgcagagcattaacggtagggtcgtctccgtaaacgtcgtccccaaccggggcggccatcatcgcttcgagcatggcgcggcttggtcgggtaacggtatcactgcgtaaatcaatcatggcatgtccttattatgacgggaaatgccaccctttttaccttagccagtttgttttcgccagttcgatcacttcatcaccgcgtccgctgatgattgcgcgcagcatatacaggctgaaacctttggcctgttcgagtttgatctgcggtggaatggctaactcttctttggcgaccaccacatccaccaacaccggaccgtcgatggagaaggcgcgttgcagggcttcatcaacttcagacgctttttctacacggatacccgtaatgccgcacgcttcggcaatgcgggcaaagtttgtgtcgtgtagttcggtgccgtcagtcaaatagccaccagctttcatctccatcgccacaaagcccagcacgctgttgttaaagacgacaattttcactggcagtttcatctgcactactgagaggaaatcgcccatcaacatgctaaaaccgccatcgccgcacatggcgaccacctgacgttctggctctgtcgcctgcgcacccagcgcctgcggcatggcgttagccatcgaaccgtggttaaacgaacctaacaggcgacgcttgccgttcatttttagataacgtgccgcccacaccgttggcgtaccaacgtcacaggtgaaaatagcgtcatcggcggcaaaatgactaatttgctgcgccagatattgcgggtgaatggctttctcgctcggtttagctaaatcgtccagccctttgcgggcgtcgcggtaatcttccagcgctttatccagaaacttgcgatcggctttttcttccaccaatggaagcaatgcacgcagagtcgacttgatatcgccgaccagtgccatatccaccttgctgtgagcgccgatgctggctgggttgatatcaatctgaatgattttggcatcggtcgggtagaaggcgcggtagggaaattgcgtgccgagtagcactaacgtgtcggcgttcatcatggtatggaaacctgacgagaagccgattaacccggtcattccaacatcatacggattatcgtattcgacatgttctttaccgcgcagggcatgaacaataggcgctttaattttcccggcaaactcaactaactctttatgcgcccccgcgcagccgctgccacacatcagggcgatattgctggaataacgcagcagttgcgccagtttgcgtaactcttcttcttccggcgtcacgactggttgtggcgcatgataccagtgcatggttgccccttctggcgcaggttttaacgccacgtcgcctggtaacacgacaaccgaaacgccacggttaagcaccgctttgcgcatggcaatcgccagtacttgtgggatctgctccgggctggaaaccagctcgcaatagtgactacattcgcggaatagctcttgtgggtgggtttcctggaaatagccgctgccaatttcgctggagggaatatgagcggcaatcgccagtaccggaacgtgattgcggtggcaatcgaacaggccgttgattaagtgcaggttgccggggccgcacgatccggcgcagaccgccagttctccgctaagttgtgcttcagcgccagcggcaaaggccgccacttcttcgtggcgggtggacatccactcgatggtgcccatgcgattaagactgtcactaagaccgttcagagagtcgcctgtgactccccagatgcgtttcacccctgccgattcgagtgttttggcgatataagctgcaaccgtttgtttcatggttctccatctcctgaatgtgataacggtaacaagtttagttcatctgacggagggggaagggatgggagagaaaggaggcactaacggttaaatagcccgatgaaaggaatatcatcgggcataaggcgattatgcgagaaccaaatccccctgcggatggcaggagcaggccagtacgtaaccttcagcgatttcggcgtcggtcagcgtcattgtgctgctcaccgtatattcaccggaaaccacttttgtcttacagcagccgcaaacacccgcacggcaggcagcgacaaccggaacgttattgctttccagcgcctccagtagcgtggtgccaaccggggcgtaaaattctcgtgccggttgcagtttggtgaatttcagaccgctggtcgccgcttctgctactggggtgaagaatttctctttaaagaaacgcgtcacgccgagcgctttcacttcctgctctacccaatccatatacggagccgggccgcaggtcatcacggtacgtgaagctaagtcaggtacacctgccagcagttcgcgagtgagacgaccagcgataaagccttcggtaacgttattttctgccaccagcgttaccggatagttacgccactcatcggcgaaaataacatcctgcggcgtacgcacgttgtagatcacccgcacatcggcctgtggacggttcttcgcaagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccactgggagccgacaccgtcatcaatccgccgcacggtcagggtgatatattcactcacgcctggcgtggaggaaatggtgtaagcacgcagcgtttccgctgagtttcgcacgctgaccagtgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacgcccagagaaagcagcgtcagcagaatgacgatcgctttctgttcaaaccaggagagcaccagcgacagcggcagatcgttgacaccgcagcccagtttctctgccagagtgacagccagaataatcgctgagtaagcatcgttacattgacctgcatctaccagacgcggcagaccttcgatatcgccaaactcaagtttgttaaagcgatatttaccacaggcgagggtcaggatcaggcagtcatccggcacgctggtggcgaaatcggtgaagtagtggcgctcgccgcgtgcgccgtcacagccaccaagcaggaagatatgacgcagtttttcacggctcaccagatcaatcagcgtatcagcagcgccaagcagcgtctggcgaccaaaacccacggtgataaggtgcggaatttcgctgtacgggaagcctgccatctgttgcgcctgggtgataaccgcagagaaatcatcaccgtccagatgacgcacgccaggccagccaacaatgctgcgggtccagatacgatcgtcataagcgcctacggttgggtcgatgatgcagttcgaggtcatcacgatggggccagggaaacgagcgaactccacttgctgattctgccagccgctgccgtagttaccgaccagatgcttgaatttacgcagctccgggtagccatgcgcaggcagcatttcgccgtgggtgtagacattaacgcccgtgccttcggtctgttccagcaggttgtagagatctttgagatcgtgaccggaaatcagaatgcatttacccgccgtcgctttgacgttgacctgggttggcgtcgggtgaccgtatttaccggtttcgcctgcatccagaatgctcatcactttgaagttcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgcgcgttggcatctacagccaggcattgcgctttcagcgcctcgcgcagggcaatcgcttcacgagcgtagccgacaatacgcggagaatcgaagttaacgttggtcagggttgagaaaaaggcacgtggcgcgaagctgtcaacatcgtggttgatgatgccgtattcacgcgcttttaccgcccaggcagaaagcccttgcagcgccgcgatgagtaaatcctgaaggtcagaagtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagggatttttcatgcaactttaagggagattgatttagcgcaattttggcggcagggatctaccgccagagaggtattacgcagagaaaaaggcgatgaggatcggcactaacaggctaagaataaaaccgtgaacaattgccgccgggaccatatccagcccgccagtacgttgaagaacgggcagggtgaaatccattgatgtggcaccgcataagcccagtgcagtagagcggctgcggcgaatcagcccagggatcaacataatagcaatcagttcacgggccagatcattaaaaaacgccgcgctcccgattaccggaccaaaagattcggtcaataaaataccggaaagagaataccagccgaaaccggaggccattgccagcgcggtattgatggggagatcaagaataaaggcgttaattaaaccaccaattaatgaactgacaaccaccaccacggcgacaatcattccccggcgattaaggacaatctgctttaaggtcatgccattattgcgcaactgaataccaacgaggaaaagtagcaaaattaacgtgtattcactggcttcggtcgcgtgttgtaagaaagccagtccacttagaccaatggcaaaaccaatcactactacgccgcacagttttagcgactccagcgccatcgcaatacgcgacgggagtttttcttgctgatggtggttgcgccacggcaggcctcgctccagccacatcagggcggcaatattacacagtaaaataacggtaatactgacggcagaataatgcagaatcgccaacaggttactggcgaggttatcgagaaacgccagactgatacccataaaaaagagaataaggtaaaccatccagcttaatagctgattaataacttttaacgcagcttgttggcgaagcggaatgaggtaacccacaatcaggggaaccagaatgattaacagcccagaaaacatgaaaacccagtccttgcaaagatgaagtcgaaatgcgcgatgacacactactgaaagcggaaggacgagtaaagttgcaattaaaaggaaatgttatgcataaggagcagtagagtattcgttttcatttaaagatattcttgcgctttaattacaaactgcaccgatgttggtggcgtcaaaatcgccgaggcgttccctgaaggccggggcagcccacatggatgtgggctgagggcgcgttttacagggatgttacctcgcgcccgacccggtagccgtaagggataagtcgagggcaccgcgcagcggcgattttgttcgccagagcccgggggtgcagggggcggcggcgattggccgccccctgcgcgctccttgcgccagtggcaatatgttgcttagctcatgaaaggagcgcaacaagatgatgaatcaacatataacaacatcttaaaaaaaggcctgacattacgccaggccttctgcgttaattaatcacgcttttccagcagggtccggtaaatcagaccaccgataatgccgccgacaattggcaccacccagaagaaccacagttgttctaatgcccagccgccctggaagatagcaaccgcggtgctgcgcgccgggttaacagaagtgttagtcaccggaatactaattaagtgaatcagggttaaggccagaccaatagcgatcggcgcaaaacctgccggcgcgaatttgtcggttgcgccgtggatcaccaacaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgctgcaacaataccgccgacaacctgggcaattacgtagccaacgacttcttttgccggaaaacgtccgccagcccataaaccaatagtgaccgccgggttaaaatgaccaccagaaatatgaccaacagcaaaggccatcgtcagaacggtcagaccgaacgccaacgccacgccggcaaaaccaatgcctaattccgggaagcctgcggccagtacagcactaccacagccaccaaaaacaagccagaaagtaccaaaacattcagctgctaattttctgaacatatccaccacaattaaaaattgaccctgtgaaaaatatggtcgttttatagggtcgtcgtaaaaaagtgacgacggaaataatgcgcggctattttaaaaacgaaggcgagtcattcaccagataaataaatccagtaaatttgatttagggcaacagcgggttgccccatatagtcatttgtctgattgacagtgtagtgcacgcaaaagatttaatcctttaggcgtaataaaaaataatttatcatgctaattatttgattttgttgtttttgcagacttatcagcaagagggagtataacgcgattattcgctcatttttcagacatttgccatgcttaaatgtgatgtcatcacgtattagcaaggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaactctgctgctatcgccagaatcagatctctaccattttgagcgcgacgatttctggttcccgccgggagatatcaacgggcgagaacatcatctgcatattattttgaccttccgcgaatcgctgccaggccgacatcgggttcgccgttatcggccgctggaagcgtgctggacgccatgcaccgatggctatcaccgtattttttatcgtctggaaggggagagtgcggaagacggcagcgtgatgacactgcgcagttttctcgataaagacggacatccgattgatgtcgaggatattaacgatcaggcacgccatctggtgcgtttaatgccggtgctgcgcttgcgtgatgcccgttttatgcgccgtattcgtaacggcacggtgccaaatgtccctaatgtggaagtcaccgcgcgccagctcgatttcctcgcccgtgagttatcctcacatccgcaaaatctctctgatgggcagattcgtcagggactttccgcaatggtacagctgcttgagcattatttctctgagcagggggccggacaggcgcgatatcgtttaatgcggcggcgagccagcaatgagcaacgaagctggcgctatctggatatcatcaaccggatgattgaccgacctggtgggcgctcgtatcgggttattttgctcggcctatttgctactttgttgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactcgggtgagttgctttcgttaacgccggtagagcatgtttgccgactggtacgtgagtcctcgcgcgttgccgcctggcgtctggggccgagtggcttgagtaccgaagatagccgacgcatatcctttcacattcgttttaaccgtccgtcatcgctgtttgcacgctgctggttgctggtggaaggggaaacggaaacctgggttatcaatgaactggcgcgtcagtgcggacatcattttgatgccgaagggatcaaggtcattgagtttgcccagtccgggctaaagccactggttaaatttgcccgccgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcatggcgcaaatcccggaaaatgtaccgatgaatctacgcaaaattatctcgaaagcgatccatcgctcttccaaacccgatcttgccattgaagtggcaatggaggcaggacgtcgtggtgtggactccgtaccgacgctgctgaaaaaaatgttctcacgcgtgctgtggctggcgcgcggtcgcgcggattaaccgcgaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcagcgtggatcttgccttctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctgatgtggaatttcccattttgcgccttgcagtccgccaataaacatcgttcttttcccctgatattcacacagggtaaacgtgatctctgccagaggaataccttcgctgttgcggaacaggattgtgctgtcaccttctttatccattgagatcatcatggtcagctcaagcgtgaactgctcgccgtttttgccttccagcttcgccagttgcagcccgggggtattcaaatataagctgaattcttccgccgacatacattcgcggagtaacgcataatggtaacgtaacgcctccagcaattgcttacggctaagattcgccgcaaggtaagggcgatgcagacgcacaggcagtcgcggctggcgcgttaacaatacattgagattaggccagtgggaaagttcgttcatccactcaacgcttaaacgcggcataatcaacgagcgcagcaaaaatttctggcgaaaactacggcgatgccagaatttacccggccgacactgtccacgtgccagactaagaaaaagtgacaggctgctgagagattcagatggcgtaaaggtccgttcagttagctgcgacatattcatgaaatcaatggttatacatggcgtcgatttcaccattgcgtatcttaaccaaacatcaatagtgtgattactaacgtaaattttagggttttgttgatatttcgttgaagttaatgacccggattggcatatggagtattcagaaaatttatgaaaaagcggaaaaccgtgaagaagcgttacgttattgcgctggtgatagtcatcgccggactgattacgttatggagaattcttaacgcacccgtgccgacttatcagacgctgattgtgcgccccggtgatttacagcaaagcgtgctggcgaccggaaagctggacgcgctgcgtaaggttgatgtgggcgcgcaggtcagcggtcagttgaaaactctgtcggtggcgattggcgataaagtaaaaaaagaccagcttttaggggttattgatcctgaacaggctgaaaaccagattaaggaggtcgaagcaacgctgatggagctacgtgcgcagcggcagcaggcggaagcggagctgaaactggcgcgggtgacgtattcccgtcagcaacgtctggcacaaacgaaggctgtttcacagcaggatctcgacaccgccgcgacggagatggctgtgaaacaggcgcaaattggcaccattgacgcgcaaatcaagcgcaatcaggcttctctcgatacggctaaaaccaatctcgattacactcgcatcgttgccccgatggccggggaagtcacgcaaatcaccactctgcaaggccagacggtgattgccgcacaacaagcaccgaacattctgacgctggcagatatgagcgccatgctggtaaaagcgcaggtttctgaagcggatgtaatccacctgaagccggggcaaaaagcctggtttacggtgcttggcgatccactgacgcgctacgaggggcaaatcaaggatgtactaccgacgccggaaaaggttaacgacgctattttctattacgcccgttttgaagtccccaaccccaatggtttgctgcggctggatatgactgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggcttgaagcgggcgatgaagtggtgattggtgaggccaaaccaggagctgcacaatgacgcctttgctcgaattaaaggatattcgtcgcagctatcctgccggtgatgagcaggttgaggtgctgaagggcatcagcctcgatatttatgcgggtgagatggtcgcgattgttggcgcttcgggttccggtaaatcgaccctgatgaatattctcggctgtctggataaggccaccagcggcacctatcgcgtcgccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgctggtcttgagcggaaacagcgactgcttcgtgcccaggagttgctgcaacggctggggctggaagaccgtacagagtattatccggcacagctttcgggtggtcagcaacagcgcgtcagcatcgcgcgggcattgatgaacggtggtcaggtaattcttgccgatgaaccaaccggcgcactggacagccattctggcgaagaggtgatggcgatcctgcatcagctgcgcgatcgtgggcatacggtgattatcgtcacccacgatccgcaggtcgctgctcaggccgagcgggtgatcgaaattcgcgacggcgaaattgtgcgcaatcctcccgccattgaaaaagtgaatgttactggcgggacggaacctgttgtcaacacggtgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggtgacgccgccaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggtcgcctcagccacacctgccgtctcgcaaaacctgcgcctgcgttataacaatgttgatgttgctgccagtgccaatggcgtgagcggcgattattttaatgtctatggcatgaccttcagtgaaggaaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctaccttacagcacgatgtccgggcgagttatgggccagtcgtggcttaactccattactgtcagggtgaaagaaggatttgacagcgccgaggcggaacagcaactcacgcgtttactttcactgcgccacggaaagaaggatttctttacctggaacatggacggcgtcttgaaaactgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagttcctgatcgaagccgtactggtttgcctggtcggtggcgcgttgggaataacactgtcactgttaattgctttcaccttgcagcttttcttacccggctgggagattggtttttcaccgttggcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggacaaggggcaggtatgaatcaaaaatttgaagcagttaacgctattgacaggaatgtgacagatgtcgctgatgccaacgatagatgatagttatctatcatgtggagtagattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattacactccgatggagtttgttattgacgtgttacaaaaattcttttcttatgatgtagaacgtgcaacgcaattgatgctcgctgttcactaccaggggaaggccatttgcggagtctttaccgccgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagctggagcgtgctattcaggttctctgccgtcgccgtaaaaacaacccgctgctggtgggggaatctggtgtcggtaaaaccgcgattgcggaaggtcttgcctggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaggacactaacagcatcctgtttattgatgagatccacaccattatcggtgcgggtgcagcgtctggtggtcaggtcgatgcggctaacctaatcaaaccgttgctctccagcggtaaaattcgtgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgcctgatgccggtaagcaaacgcaagaaaaccgttaatgtggcggatattgagtccgtggtggcccgtattgcacgcattccagagaagagtgtttctcagagtgatcgtgataccctgaaaaacctcggcgatcgcttgaaaatgctggtcttcggtcaggataaagccattgaggcgctgactgaagccattaagatggcgcgtgcaggtttaggtcacgaacataaaccggttggttcgttcctgtttgccggccctaccggggtcgggaaaacagaggtgacggtacagctttcgaaagctttgggcattgagcttctgcgctttgatatgtccgagtatatggaacgccataccgtcagccgtcttattggtgcgcctccgggatacgttggttttgatcagggcggtttgctgactgatgcggtcatcaagcatccacatgcggtgctgctgctggacgaaatcgagaaagcgcacccggacgtgttcaatattctgttgcaggtgatggataacggtacgctgaccgataacaacggacgcaaagcagacttccgtaacgtggtgctggtgatgaccaccaacgccggggtacgggaaactgagcgcaaatccattggtcttatccaccaggataacagcaccgatgcgatggaagagatcaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgctcgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgttaggtaggttggtcaagtccgtaatctcgaaagaggttacggactttttgtttatggggtggaggaggttcagaccctttttttaatgatgatggtaagttgttgataattagtgctgcgggaaggtaaggataaaaaagggtgctgcaggagaatgggatggttttgctttattaacaacgggctaaacgtgtagtatttgagttcactgccgtacaggcagcttagaaattcacaggtaacatactccacccgcccaccatgttcactgccgtacagacagataaaatgcgaaaaaaaagctcgcactttcgtacgagctcttctttaaatatggcggtgagggggggattcgaacccccgatacgttgccgtatacacactttccaggcgtgctccttcagccactcggacacctcaccaaattgttttgctaccaaacctcatgggtggcaacggggcgctactatagggagttggagtaaaacggtcaagaagaattttaatgataattattgtttgctcatactgtaaacaagttgtgcagtatatctacatcgagacaagttacggacttatacttccaaagtacttcatacatatcacaaaataaaaaggccggttaaaccgaccttttactcgttctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgtggtacccagaaattattcggcaatcgtccgaggcgcatttgattgagataattaaggtaatcccggcggggaatttcgcaggcaccaagcgatgctgtgtgatcgttaaggacctggcagtcgataagcttaccgccatgaccgataaattcctcacagaataccagaagcgccgttttagacgcattttccatccggctgaacatggactcgccacaaaatagcgttccctgggccacgccgtacataccgccgacaagctcatcttcacgccagacttcaatggagtgggcatggccgagttcgtgaaggcgatggtaggcttcgaccacgccacgcgtgatccaggttccttcttcgcgatcgctggcacagccttcaatgacctgaccaaaagcgtaattcatcgtgacacgatagggcgagcgtttatgaaatcgcttcatactacggctgatatgcagtgattctggccatagcaccgcgcggggatcgggcgaccaccagaggatggggtcgcctggagaaaaccacggaaaaataccacgctggtaagccattaacaggcgcgcagggctaagatcgcccccaagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttgaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcacgcatcatttctgcaagcaattcaaggatctggctttcggttgtggcatctaagccttcggtaggttcatccagcaacaccagtggcgcatcatgtaacagcgcacgggcgatagccagacggcgcagttcaccaccggagagctggcgtccgccttcacctaaccaactgttgagacctgcatcctcgagcagcttttccaggccaacgcgacgcaagatctccgacagagcctcatcactactgccaggcgaggcgagtaaaagattatcacgcagcgtggcgctaaacagatgcactcgctgaggaacaacgctgatggtctgtcgtagagccgcttcattcaggctggctatggggctatcgttaagcaaaatctcgccctgttgcgggtcccatgcgcgggtcagctgttgtaacagtgttgatttgccgcatccggttcgcccgagaatcgctatatgttccccggcgtttacctgaagagaaatccctttaagtgcctgttgagattgctccggataagtgaactgaacatcccgtaacgtcagcgaaacgcgatcggcaacacgagtttgggtatcaggaaaggtgacctccggtttttgatccgttaagtcagagatacgtacggcagaggcaatgacttgccccagatgctgaaatgcacccgttactggtgccagtgcttcaaacgcggctaacgcgcagaagacaaacagggcaattaacgcgccgggttgagcattgccgccaacgccgccagacgccatccacagcatcaggatcaccgctaacgcgccaatgagcagcattatcgcttgcgacaatgcggtcagttcagattgacggcgttgcgcttccagccattgaatttctgtattctctagttgcgtgcgataacgatcgctggcaccaaaaatggtcagctcagcttgcccttgcagccaggccgtcagttgttggcgatactgtccgcgaagatgagtcagattttgcccggtgctttttcccgcacgataaaacagcggtggcatcaggaaaagcgtcagtaacataatgccgcccagcgtaaaggcgagggtgaaatcaaggaaacttaacccgattgtcaccaccataatcaccacaaaagcgcccaccagcggcgagataacgcgcaggtaaagatgatcgagcgtatcaacatccgccaccacgcgattgagcaattcgccctgacgatagcgcgccagtccggcaggggagaggggcagcaatttgctgaaggtgtaaatgcgcagatgctgcaacacgcggaaagtcgcgtcgtgacttaccagacgttcaaaatagcgcccggcagtacgggtgattgctgcgccacgcacgcccgcagcgggtagcatatagttgaagctgtacagtccggcaacccccgcaaccgctgaggccgagaggaaccagccggaaagtgtcaacagaccgatactggcgagcagcgtcacaattgccagcacaataccaagacttaacatccatttatgacgtttatacagtgccagatagggtagcaaagcgcgcatttaaatctcctcctgacgatgggccagtaatgtggcgaatgggccaccagccacacttaattccgcgtaacgtccttgctcaataatccggccatcctgcataacccaaatgacatcccagtcagcaagatcttctaactggtgggtgaccattaacgttgtctggcgcagagaggcggcattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcgccaacaggcgtatcaacgccttgtgggaggagcggtagaaactcgctgacccaggcgttatccagcgctgcttgtaattcttgttcgctggcatcaggtcgcgccagtagtacgttatcccgcaatgttgctgccggtaattgtgggttttgcccaacccaggagagatgtttacgccatgattctggtgataaatcgcgtaattctatcccgttgattcgtagcgatccctgatatgagagaaaaccagaaagcgcgttcagcagtgagcttttacctgaaccgctgcgaccaaccaacaccgcacgttggcctgctggcaaagtaaagttcagcggtccggccagcgttttaccttccggcgacgtgataaacagctcctcggcctcaatggtcaccggatcggtcgatgctaattccgcctcaccacgttgcggatgggcgagcggggtttccataaacgttttcagactgtcagctgcgccaacagcctgggctttagcatgataaaacgtaccgagatcgcgtaatggctggaaaaactctggcgcaaggatcagggccagaaaacccgcagccagcgtcacaccggtatcgtagtgaccaaaatccagctcgccgagataggaaaaaccaaagtagaccgccaccagagcaattgacagcgaggtaaaaaattcgagaatgccggaggataaaaacgccagccgtagcacttccattgtccgttggcggaaatcttccgaagcagaacgaatactttcaatttcagcttcaccacgaccaaaaatacgcaatgtttccatgccgcgcaggcgatcgaggaaatgcccacttaagcgagcaagagcgagaaagttacgtcggttagcatcggcagcccccattccaaccagcgccataaacaacggaattaacggtgcagtgcccagcagaatgagcgccgcagcccagttagaggggaagattgccaccacaatcagcaacggcaccgacactgccagcgccatttgcggcagatagcgtgcatagtaatcatgcatatcgtcaatttgctcgagtaccagcgtcgcccagctccccgcaggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaccagtaacgtaaagggaagcagcagggcttcacggggaatattctccataatcatatgttgcagaattcgcgccatgaaccaggcctgggcaatgatcaatatgccgctcacaaagcccagcagacgagaaatattcagccaacgttgggagatgacgctttgctgttttaaccagcgggttaactctttttgacgagatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccatcgaggtagcgttccgcatcaagtgctgccatgcagcctgtaccggccgaagtaatggcctggcgataaatgtgatccatcacgtcgcctgcggcaaagacgccaggaatgctggtctgggtggcattaccatgaatacccgactgtactttgatgtagccgttttccagttccagctgcccttcgaaaatcgcagtattcgggctgtgaccgatagcaacaaacagaccggcaacgtcgagtgactcgatgttatcgctgttttgcgtatcgcgcagacgaacgccagtgacacccatttgatcgccggtcacttcttccagcgtacggttggtgtgcagaatgatgttgccgttctccactttatccatcaggcgcttaatgaggattttttccgcgcggaaaccgtcacggcggtgaatcagatgcacttccgaagcgatgttagacagatacagcgcctcttcaaccgcggtattgccgccgccgatgaccgcaactttctggttgcgatagaagaaaccgtcgcaggttgcacaagcagaaaccccacggcctttaaaggcttcttcagagggcaggccgagatagcgtgcagaagctccggtggcaataatcagcgcgtcgcaagtgtattcgccgttatcgccattcagacggaacggacggttttgcagatccaccttgttgatatgatcaaaaatgatctcagtttcaaacttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatgggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaataccatgtttaccgtgctagtgaaatctacgtatggcgtggacagacgccattcgtgatgtcgatagctgccacaaggcaacggtcttctcaccgtagacccaggcattgcgcgccgtgaatcttcatgatttcggtctatcgtgacgggtagcgactctgaacagtgatgtttcagggtcagacaggagtagggaaggaatacagagagacaataataatggtagatagcaagaagcgccctggcaaagatctcgaccgtatcgatcgtaacattcttaatgagttgcaaaaggatgggcgtatttctaacgtcgagctttctaaacgtgtgggactttccccaacgccgtgccttgagcgtgtgcgtcggctggaaagacaagggtttattcagggctatacggcgctgcttaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtcagcctaccgtaagttgctgggggaaaccctgctgcgtctgcctggcgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacattgaagacaaagaagtcacattgacaaagttaagtagcggccgccgccttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgttgttcaccggttggtcatgggtgaccattgctgaaaaactcggcggctggattttaaacattctcaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagacgctgcgttgttctccggtaagcggatggatgatgacgaagagattacctacactgcacgcggtgtggctgccgacccggacgacgtcctattttcgggcaatcgtgcaacgcagccagaatatgacgaatacgatccattattaaacggtgcgccaattaccgaacctgtcgctgtagcagctgctgctaccacggcgacacaaagctgggctgcgccggttgaacctgtgactcagacgccgcctgttgcctctgttgatgttccacctgcgcaacctacagtagcctggcagcctgtaccgggtccacaaacgggagagccggttattgctcctgcaccggaaggttacccacagcagtcacaatatgcgcagcctgcagtgcaatataatgagccgctgcaacaaccagtacagccgcagcagccgtattatgcacctgcagctgaacaacctgcgcaacagccgtattatgcccctgcgccagaacaaccggtggcaggtaacgcctggcaagccgaagagcagcaatccacttttgctccacagtctacataccagactgagcaaacttatcagcagccagccgctcaggagccgttgtaccaacagccgcaacccgttgaacagcagcctgttgtggagcctgaacccgttgtagaagagacaaaacccgcgcgtccgccgctttactactttgaagaagttgaagagaagcgagcccgtgaacgtgaacaacttgcggcctggtatcaaccgattccagaaccggttaaagaaccagaaccgatcaaatcttcgctgaaagcaccttctgttgcagcagtacctccagtagaagccgctgccgctgtttccccgctggcatctggcgtgaaaaaagcgacactggcgacgggggctgccgcaaccgttgccgcgccagtcttcagtctggcaaatagcggtggaccgcgtcctcaggtcaaagaggggattggtccgcagttgccacgaccgaaacgtatccgcgtgccaactcgtcgtgaactggcgtcttacggtattaagctgccctcacagcgtgcggcggaagaaaaagcccgtgaagcccagcgcaatcagtacgattctggcgatcagtacaacgatgatgaaatcgatgcgatgcagcaggatgaactggcacgtcagttcgcccagacacagcagcaacgctatggcgaacagtatcaacatgatgtgcccgtaaacgcagaagatgcagatgctgcggcagaggctgaactggctcgtcagtttgcgcaaactcaacaacaacgttattccggcgaacaaccggctggggcgaatccgttctcgctggatgattttgaattttcgccaatgaaagcgttgctggatgatggtccacacgaaccgttgtttacgccaattgttgaacctgtacagcagccgcaacaaccggttgcaccgcagcagcaatatcagcagccgcaacaaccagttccgccgcagccgcagtatcagcagccacaacagccggttgcgccgcagccacaatatcagcagccgcaacaaccggttgcgccacagcagcaatatcagcagccgcaacaaccggttgcgccgcagcagcagtatcagcagccacaacagccagttgcgccacaaccgcaggataccctgcttcatccgctgttgatgcgtaatggcgacagccgtccgttgcataaaccgacgacgccgctgccttctctggatttgctgacaccgccgccgagcgaagtggagccggtagatacctttgcgcttgaacaaatggctcgcctggtggaagcgcgtctggctgatttccgtattaaagccgatgtcgtcaattactctccggggccggttatcactcgctttgaattgaacctggcaccgggcgtaaaagcggcgcgcatttctaacttgtcacgggaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaaatctgtcggtgtgaacgcgatgatcctgagcatgctttataaagcacagccagaagatgtgcgtttcatcatgatcgacccgaaaatgctggagctttcggtttatgaaggcattccgcatctgttaacggaagtcgttactgatatgaaagatgccgccaacgcgctgcgctggtgtgttaacgagatggagcgtcggtataaactgatgtctgcgctgggtgtgcgtaatctggcgggttataacgaaaaaattgctgaagccgatcgcatgatgcgtccgattccagacccgtactggaagccgggtgacagtatggatgcccagcatccggtgctgaaaaaagaaccatacattgtggtgttggttgacgaatttgccgacctgatgatgacggtaggtaaaaaagtggaagagctgatagcacgtctggcgcaaaaagcccgtgccgcgggtatccacctcgtactggcaactcagcgtccatcggttgatgttattactggtctgattaaagcgaatattccgacccgtatcgcctttaccgtatccagtaagattgactcacgtaccattcttgatcaggctggcgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagcgaaagcgaaggtggtgcgggtggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggtaatcgtgaagtgctggccccaccgccgtttgactaactaatgcatcgtatgccggataaggcgcggtagcgtcgcatccggcactctatcaactgaaaattcagtattttcttctttcctcaagctgattattagcctggaatagagagtagagggaactcccgatcgggagtgacgtaatttgaggaataatgatgaaaaaaattgccatcacctgtgcattactctcaagcttagtagcaagcagcgtttgggctgatgccgcaagcgatctgaaaagccgcctggataaagtcagcagcttccacgccagcttcacacaaaaagtgactgacggtagcggcgcggcggtgcaggaaggtcagggcgatctgtgggtgaaacgtccaaacttattcaactggcatatgacacaacctgatgaaagcattctggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgtcctgacgccgaaagccagcaatggcaatctgaagcagttcaccattaacgtgggacgtgatggcacaatccatcagtttagcgcggtggagcaggacgatcagcgcagcagttatcaactgaaatcccagcaaaatggggctgtggatgcagcgaaatttaccttcaccccgccgcaaggcgtcacggtagatgatcaacgtaagtagaggcacctgagtgagcaatctgtcgctcgatttttcggataatacttttcaacctctggccgcgcgtatgcggccagaaaatttagcacagtatatcggccagcaacatttgctggctgcggggaagccgttgccgcgcgctatcgaagccgggcatttacattctatgatcctctgggggccgccgggtaccggcaaaacaactctcgctgaagtgattgcccgctatgcgaacgctgatgtggaacgtatttctgccgtcacctctggcgtgaaagagattcgcgaggcgatcgagcgcgcccggcaaaaccgcaatgcaggtcgccgcactattctttttgttgacgaagttcaccgtttcaacaaaagccagcaggatgcatttctgccacatattgaagacggcaccatcacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcactgcataagtcggtacgtggtagcgcacccgatgcggcgctgtactggtatgcgcgaattattaccgctggtggcgatccgttatatgtcgcgcgtcgctgtctggcgattgcgtctgaagacgtcggtaatgccgatccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgcccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttactgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaagagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctgaccatccctaacctgcctgcagatgaagtgccggtaggtaaagacgaaaatgacaacgttgaagtcagccgctggggtaccccgcgtgagtttgactttgaagttcgtgaccacgtgacgctgggtgaaatgcactctggcctcgactttgcagctgcagttaagctgactggttcccgctttgtggtaatgaaagggcagattgctcgcatgcaccgcgcactgtcgcagtttatgctggatctgcataccgaacagcatggctacagtgagaactatgttccgtacctggttaaccaggacacgctgtacggtacgggtcaactgccgaaatttgctggcgatctgttccatactcgtccgctggaagaagaagcagacaccagtaactatgcgctgatcccaacggcagaagttccgctgactaacctggtgcgcggtgaaatcatcgatgaagatgatctgccaattaagatgaccgcccacaccccatgcttccgttctgaagccggttcatatggtcgtgacacccgtggtctgatccgtatgcaccagttcgacaaagttgaaatggtgcagatcgtgcgcccagaagactcaatggcggcgctggaagagatgactggtcatgcagaaaaagtcctgcagttgctgggcctgccgtaccgtaaaatcatcctttgcactggcgacatgggctttggcgcttgcaaaacttacgacctggaagtatggatcccggcacagaacacctaccgtgagatctcttcctgctccaacgtttgggatttccaggcacgtcgtatgcaggcacgttgccgcagcaagtcggacaagaaaacccgtctggttcataccctgaacggttctggtctggctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacacgtaatactactttcgagtgaaaatctacctatctctttgattttcaaattattcgatgtatacaagcctatatagcgaactgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaaggagtaaccgatgacaacccagtatggattttttattgattccagccgttgcaccggttgcaaaacctgcgagctggcctgtaaagactacaaagatttgacgccagaagtcagcttccgccgcatttatgaatatgctggcggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtgagatgggaagtggatggcatgaatggccgctgatgatcttcacggtcttcgggcaatgtgtagcaggtggttttatcgttctggctttggcgctgctcaaaggcgacctgcgagcagaagcccagcagcgtgttatcgcctgcatgtttggtttatgggtgctgatgggcattggctttatcgcctctatgctccatcttggttcaccaatgcgcgcttttaactcgctcaaccgggtaggggcttcagcactcagtaacgaaatcgccagcggttcgatcttttttgccgtaggcggcatcggctggttgctggcaatgctgaaaaagctgtcaccggcattgcgtacgctgtggctgatagtgacgatggttcttggcgtcatctttgtctggatgatggtgcgtgtgtataacagcattgataccgttccgacctggtacagcatctggacgccgatgggcttcttcctgacgatgtttatgggcggcccgttactgggttacctgttgttgagtctggctggcgtcgatggctgggcgatgcgtctgctgccagcaatttctgtactggcactggtagtgagtggcgtggtgtcagtgatgcagggcgcagagctggcgactattcatagttctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgcggcgtattctatggtttgcatatgaccgtggggatggccgtcgcaagctaatcataacaaccggggtttcggccccggttctcttttatttctgcttcgttaacgtgtcataactggtcatcaaattacgataatcaggaatgtggttagagaacaacgtcgccagtccttcaatatcattacgccagtcgcgatgcagctcgcacgccacgccgaaccatgtcatcaattgcgcaccagcttgcgacaagcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgtatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatcccgtacaagggaaagtaaaccagcctggtgatcaacaagcaaaacggcagcatcatttttatcaagacgaacatacggtttggtcatcctcttctcctttcgagagtcagtggtacgtctgaaatcgatcagacgcgatgcattgctctgaaagcatagacgggaaatatgagtttgctgtgaccatgaaatttttcgactgaacgaagcgtatgaaatttgtgttagttcaataaaaacaatcagatgagactaatcatctcttcagcattagcgttatgaatgagtaatataaatcgataataccgccgctgggatatcgcgtattttcacccattgacaatgtttttggcggtggcatgatgcgcatgaaatttgaacttcctcacggttttaattcatgtccacgtatacccagcctgtcatgcttttgctgtctggcctgcttttgttgactctggcgattgcggtgttaaatacactcgtgccgctttggctcgcccaggaacacatgtccacatggcaggtaggcgttgtcagctcatcctattttaccggcaaccttgtcggtacattgctgacagggtatgtcattaagcgcattggctttaaccgcagctattatctggcctccttcatttttgccgctggctgtgccggccttggcctgatgattggattctggagctggttggcttggcgttttgtcgcgggcgtcggctgtgccatgatttgggtggttgttgagagcgcgctgatgtgcagtgggacgtcacgtaaccgtgggcgtttgcttgctgcgtatatgatggtttattacgtgggaacgtttttaggccagttactggtcagcaaagtttcaaccgagctgatgtccgtattgccgtgggttacaggtttgacgttggcagggatcttaccgctgttgtttacgcgtgtgctgaatcagcaggctgaaaaccatgattcgacgtcaattacgtcaatgctaaaactccgtcaggcgcggcttggcgtgaatggctgcattatctcaggaatcgttctgggatctctatatggcctgatgccgctgtacctcaatcacaaaggggtgagcaatgccagcattggtttctggatggcggtactggtcagtgcgggtatccttggacaatggccgattggacgtctggcggataagtttggtcgactgctggtgttgcgtgttcaggtctttgtcgtcattctcggcagtatcgcgatgcttagccaggcggcgatggccccagcgttattcatcctcggtgccgctggctttacgctatatccggtggcgatggcatgggcttgcgagaaagttgaacatcatcaactggtggcgatgaaccaggccttactgttgagctatactgtgggaagtctgcttggcccgtcatttaccgctatgctaatgcagaatttctccgataatttattgtttatcatgatcgccagcgtatcgtttatctatttgctgatgctgctgcgcaacgccggtcatacgccgaaacccgttgctcacgtgtaaatgaattcaagcagagtgtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttaccgatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcactcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataattattgtggtcggtgacgctgactctggcagatctgacccgtttttacataatcgagaaatgcgcgcaagccgcaggacatatactggcggtttggataatagatctggaagcctggacgctctgtgctccagtcttccagtacacattctaaacgaccagtatcaaggtactccttgatctgttcatagagcagatacccgataccagcacccatcaaaacggcctccagttcagcatcaacatcatccagaatgatatttcctgcgacagcaatttccagctcctttgcaaattgccagtggaaaggtttgccgctgggataacgaaaaacaacacattgatgattaagcagatcatgaggatggcggggtttgccatatcttgcaaagtactctggcgttgctgctacacataatttcactggcgggccgatcgccacgctgatcatatctttttcgacgatgcaactaagtcgaacgccagcgtcaaagccctgttggacgatatcgacaagagagtcgtcagttgtgagctcgactttaatatcaggatattcacgtgtgaaaccaaccagtaaagacattaaaaatatacgtgcagctacccgggcggcattgattttgagcgttcctgtcggtgtcagacgaaaatcattcatctcatctaacatgatctgaatttcgtcgaaagctgggcgcaatcgttcatagagattagaacccgcttccgttaacgatacgcttcgggttgtccgattgaataagcgaattttaagacgttgttccagtgttttaatactatggctaatggcggacgaggataagcctaactcatcgcccgctgcacgaaagctttgattacgggccacggcaaagaaagtggcaaagtcagacatattcatccgcattagtgaaaatccttcattaactcatcctgaatcatcacgtttacaggattatgccgcctgcgtaaagtgcgctccagaacttaacgtggaggtaaaattatgcagtctgaacgtatttatttggtatgggcccatcctcgtcatgattcattgaccgcacatattgctgatgcgatccatcagcgggcaatggagcggaaaatacaggtgacggaactcgatttatatcggcgtaatttcaacccagtgatgacgccggaagatgaaccagactggaagaatatggataaacgttattctccagaggttcatcagctttattcagagctgcttgaacatgacacgttagtggtggtttttcctctctggtggtacagcttcccggcaatgctaaaaggatatattgacagagtatggaataatgggctggcttatggagatgggcacaaattaccattcaataaagttcgttgggtggcgctggttggaggagacaaagaatcatttgtccagatgggctgggaaaaaaatataagcgattatttaaaaaatatgtgcagttatcttggtattgaagatgccgatgtcactttcttgtgtaatacagtggtattcgatggggaagaacttcacgcgagctattatcagtcgttattatctcaggtacgggatatggtagatgcactataagatgtgttaaaaacgctgtagcagaatgaagcgcggaataaaaaagcggcaactcaataaagttgccgctttacggggaaattagaacattaccttatgaccgtactgctcaagaatgcctttcacgcgttccatggtctctttcttcggtggtttaacaccgtcgagtttgtactcttcacccattgccacccatttgtgtttgcccagctcgtggtaggggagaagctcgattttctcaacgttgcccatatcacgggtaaattcaccgaggcgatgcgctgaatcgtcatcgtcagaccagcctgggacaacaacgtagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgcaggattgcttcaccgccggatgcggtaacgccgccgccggaagcgttcataaagtggcgataggtcaccacttccttcatcaaatcttcaacggtaacttctttaccgccatgcgtgtcccaggtgtcgcggttatgacaatacaggcagcgcatcaggcagccctggaaaaaggtgataaagcgaatacctgggccgtctacggttccacaggattcaaaggagtgaatgcgaccaataactgacattgcggtgtttctccagatgtggcccatctgaggccgtgttggtgcgcagctcgaaggctacgtcgagtctgttttggcagtcaccttaaagtatagatagctgacaaaaaaggctctcgcgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagaggctactgcacctttctggtcacgaccgtgcatcgggttagcacccggtccgaacggcgcgccagcacgacgaccgtctggggtgttacccgttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcattgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaagtgaactgtgccagtttgtctttcatcaggtagtcgataccgtacagcgcaacgcgacggtagtcaccgatgatacggccacggccatatgcatctggcagaccggtcagaacaccagatttacggcaacgcaggatgtccggagtgtaaacgtcgaacacgccctggttgtgagttttacggtattcagtgaagatttttttgatcatcggatccagttcgcggttgtacgctttgcaggaaccttcgatcattttgataccaccgaacgggataagagcacgtttcagcggagcttcagtctgcagaccaacgattttctcaagctgcttgttgatgtagccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtggtcgttttcacgcaggtaaatgacccagtatgtcaacccaaccaacaaaccaccaccgataatgttgccgatcgtaaccggaatcaggttatcagtgatgaaattcatcacggtcaggtgagaaaaattttccggtgcagaaccgactgcggtccaaaattccggggatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggtttgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaatagacatttagccagtttttcgccaactgaccccaggtgatgcgcccactcgccttagcaacaacaatcaacacggtggaagtaaagagatcggctccgcagacaacacaaagaatcagccccagagagaagcaaatgccgccaaccagttttgccatgccgaagggcattgtgcctgtgccagtggttgctgtgatatagaagacgaatgcgattgagatgaaaacaccggcggtaatcgccagatagaaagtcttaagcggatgtttcgttgctttatagacacccgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcatcaggcgaataaagtaacaatatcgatcgtatttattaaatacaaattaccgatatttaaccttataattacaattattttattaatgcaaatatatgtaaagcggggcattaaaaaaacgccccgtaatataactcagactaatcattaagcctacattgcgtaggctatttgattttattttgcccagaatgctgctttggcgcgctgcagcttttcgtaggccttcaacaacgactgatgtgcagcaaacgcgtgcagatcgctatctaccggttgcaggccgtaaaacgccgcttcgccgctcattgccgcactggcggcttctacggcatctgcgccgtacatgcgaacaaacgcattcagatattgcagcggctggcgatcttcttcctgtgccagtaataacaacgtttgcaggcagcgataatagttggcgcgttccggactaaatactgatgagttaaactccatcgtccattcggtccagaccagagcctgttccagatcgccaccagccagcgccagcatggcttttaattcaccgatacgcagggtgtaccaaccgttatccgacccggtcgccagacccaacagctcacgcacgcgggtaaagtcatcaaaaccttcttcatccagttgctcgatgaggttcaggtaatcttctttttcccactcgctgcctggtagcgaaagaatcgtttcacgtaaatggctgcccatactgttattcgcgagccacagatcttcagccggataaatatcggacatgccaggcacgataatacggcaagcataaacgcccagatgctcgtaatcggcaatataaacttctttatcttctttgttgaagatagccatcagtgtggcgaactcttcttccgtggtgccggagaaattccagtccacaaacggataatcggcatcctgcttgaacaggtcccaggagattaaaccgctggaatcgataaagtgcgtttcgaggttggtatgttcagcgacttcttcatcatcgaaggttggcggagtaaacacatccaaatctttcaggccacgaccttgcagcagctcggtcacggtacgttccagtgctacgccaaaatcaggatgcgcaccgaaagaggcaaagcaggtaccgttagcaggattgaacagtaccacgcaaatcaccggatactggccgccaagcgaaccgtcataagcgaagattgggaaaccctccgcttccagcgtttcgatggcttcaactactgctgggtaacgcgccagcacgtctgccgggatctctggcaggctgatgctttcagcaataatgcggtttttcacgtagcgttcgaaaacttcagacaatccctgaacgcgtgcttcgttgcgggtattacctgcggacataccgttggagacgtacaggttaccaatgatattcatcggaatataaacggtctgattgtcggactgacgcgtaaacggcaggccgcaaataccacgatcttcgttaccggattgtaggtcaatcagcatgctgccggtcagttcattctccggatcataaaacgcgcgcagacggtcatcgagcagcccttctggcacatcgtcattttcggtcagtgggaaccatttttcgttgggataatgcacgaacggaccgttggcgatggtttcgcccagccagaagtccgcaaaaaagtagttggttgagagacgctcgaaatattcaccgagtgcagaagccagcgccgctttcttggttgcgcctttaccgttggtaaaacacagtgcgcactctttgtcgcgaatatgtacagaccagacgttaggcacgggattcagccaggaggcctcttcaatctgaaagccgaggtctgaaagtttttgctggaagcgagcgatggaatcttccagagcggcatctttgccggggataaatgtttgcgtcatgaaaatcactttagtcgtacggaaagcgcgcaataatacgggttttatctcaaaggcgctatcaccgccgccatgccgatgaactgttgactatgcttttagcggataaaccacgttaagagcataaaaatgaaggcgttcgatctccaccgtatggcatttgataaagtgccttttgatttccttggcgaagttgcactacgtagtctttatacctttgtactggtctttttgttcctcaaaatgaccggaagacgcggtgtgcggcagatgtcgctgtttgaagttttaatcattctgacgctgggatcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccagttgtcattattgaagatggcgagctggcctggtcgaaactcaataactccaacatgacggaatttgagttctttatggagctacgattgcgtggcgtggagcagctggggcaggtacgtctggcgattctcgaaaccaacgggcaaatcagtgtctatttctttgaagatgacaaggtgaaaccgggtttacttattttacccagtgattgtacgcagcgttacaaagtggtgccggagtcggcggactatgcctgtattcgttgtagtgaaatcattcatatgaaagcgggggaaaaacaattatgtccgcgctgtgcaaatccagaatggacgaaggcaagtcgggcaaaacgggtgacctgacagtaaaaacatcggctttttgctaataatccgagagattcttttgtgtgatgcaagccacatttttgccctcaacggttttactcattgcgatgtgtgtcactgaatgataaaaccgatagccacaggaataatgtattacctgtggtcgcaatcgattgaccgcgggttaatagcaacgcaacgtggtgaggggaaatggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaatgccgaaattttgcttaatccccacagccagcctgtggggtttttatttctgttgtagagagttgagttcatggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctgaatgaacaacgggcaataaatagccaaatctttctttatcaaaacgtcggcacattgtcggcgttttttttcggaccttgtgagtcattttgattaatggtagcgtcgcttgtcaatgtaagttgttgatacataatatttatatatgattaatcaacggatgattcacatgaagaatactaaattactgctggcgattgcgacctctgcagcattactgacagggtgtcaaaatacccacggtattgataccaatatggctatcagctccggtttaaatgcctataaagcagcaacattaagcgatgccgatgcaaaagcgattgccaatcagggctgtgccgaaatggacagcggcaatcaagtcgcaagtaaatccagcaagtacggtaaacgtctggcaaaaatcgccaaagcattgggtaacaatattaatggcacgccggtcaactataaggtttatatgaccagcgacgtcaacgcatgggcgatggcgaacggctgtgttcgtgtctacagtggcctgatggacatgatgaatgacaacgaaattgaaggcgttctgggccatgaactgggccacgtcgcgttgggtcactcgctggctgaaatgaaagcttcttatgcgatcgttgccgcacgcgatgccatttcagctaccagcggtgtggcttcccagctttcccgctcacaattaggtgatatcgcagaaggcgctatcaatgctaaatactcccgtgataaagagtccgaagcagatgatttctcctttgatctgttgaagaaacgtggcatcagcacccaggggctggttggcagctttgaaacactggctagcctggatggcggtcgcacccagtccatgtttgactctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggactcgggtgcaatttatcgcgtactggcattggcggcattacatcaccatgttgatgttgcgtcggaagatgcgctggtaccgctggcatcccatctggatgtacgttttgtgtcgaccaatggcaatctggaagtgatcctcgaaggggaagatgtcagcggcgaaattcgtactcaggaagtggcgaatgcagcttcacaagtcgcggcattcccacgcgttcgtgaagcattattgcgtcgccaacgcgcgtttcgcgaattaccaggtctgattgccgatggccgcgacatgggaacggtggtattccctgatgcaccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaatttaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggactggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcttggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaacctggtaaagaactgcgcgatcgcgccaatatttacggttaagttttttactcaaacttgaacgagagaaaagcacctgtcgggtgcttttttcatttctctaatctggaactggaagctgcctcgcagagttttgaacagttttcaccctttcgttaaattcttctgaatatgcctcggggaacgcaaaattcccaccagacaaccgctcaacaaagttgcacactttccataaacagggaggggtgcatgaaaataacgacagtcggtgtatgcataattagcggaatttttccgttgctgattttgccccaattgcctgggacattaacccttgcgtttctgactctcttcgcctgcgtactggcatttatccctgttaaaaccgtccgttatatcgcgctgacgttgctgtttttcgtttggggcatattatcagcaaagcaaattttgtgggcaggagaaaccttaactggcgcgacgcaggatgcaattgttgagatcactgcaactgacggcatgaccactcattacggtcaaattactcatctacaaggtcgacgtatattccctgcgtcaggtctcgtgatgtatggcgaatatcttccgcaagcggtttgtgctggacaacaatggtcaatgaaactcaaagttcgtgcagttcatggccaacttaatgatggcggctttgatagccagcgttatgccattgcccagcatcagccgctcaccggccgttttctgcaggcaagtgtcattgaaccgaattgtagcctgcgtgcacagtatctggcgtcactacaaacaacgctgcaaccctatccgtggaatgcggttattcttggtttaggtatgggggaacggttatccgtccccaaagaaatcaaaaatatcatgcgcgatactggaacggcgcatttaatggcgatatcgggattgcacatcgcttttgcggcgttgctggctgccggactcattcgcagtggacaaatttttctgcctgggcgctggatccactggcaaataccattaattggcggaatctgctgtgctgctttttatgcctggttgacgggaatgcaacctcctgcattgcgtaccatggtggcgcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatccatctgcaactgggaatcacacttctgcttatgcccgtgcaaatcgtcatatttcatggcattagtctgacctcgtttattgcaaatctattagcaattcccttggtgacatttatcacggttccgttgatcctcgccgcgatggttgtgcatttaagcgggccgttaatcctggagcaagggttatggtttcttgccgaccggtctttggctttacttttctgggggttaaagagtttgccggaagggtggatcaacattgctgaatgttggcaatggctatcattttccccatggttcttactggtggtatggcgattaaacgcctggcgaacgttgccagcaatgtgtgtggctggaggcttgctgatgtgctggccgctgtggcaaaaacctcgacctgacgagtggcagctgtacatgcttgatgtcgggcaagggctggcaatggtgatagccagaaacggcaaagcgattctctatgacacaggactggcctggcctgaaggggatagtgggcaacaactgattatcccctggctccactggcataatcttgaaccggaaggcgttattctgagccatgaacatctggatcaccggggagggctggattcaatattgcatatatggccgatgttatggatcagaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaaggttgatgacgggacgaatagcattcttctaaccggtgatattgaagccccagctgaacaaaagatgctaagccgttactggcagcaagtgcaggcaacattgcttcaggtacctcaccatggcagtaatacctcatcatcgttgccattaattcagcgagtgaatggaaaagtggcactcgcatcggcatcgcgctataacgcatggcgactgccctctaacaaagttaagcatcgctatcaactgcaaggatatcaatggattgatactccacatcaaggtcaaacaacggtcaatttttcagcgcaaggctggcggattagcagcctcagggagcaaattttacctcgttggtatcatcagtggtttggcgtgccagtggataacgggtagaatatgcggctatttcaacaaatgctggttttttgaatgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatgatcgaaaaaatctggtctggtgaatcccctttgtggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagttgcaacagcgcggtattcgcgtgggggtcgtatcgcggggatatggtggtaaggctgaatcttatccgctgttattgtcggcagataccacaacagcacaggcgggtgatgaacctgtgttgatttatcaacgcactgatgcgcctgttgcggtttctcccgttcgttctgatgcggtaaaagccattctggcgcaacaccctgatgtgcagatcatcgtaaccgacgacggtttacagcattaccgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtccctcgcagcggtgaaatccccatgcatctgctgccgggtcaggcggtgaatttacgtaccggtacgcgttgtgacgttgctcagcttgaacatgtagtggcgatggcggggattgggcatccgccgcgcttttttgccacgctgaagatgtgtggcgtacaaccggaaaaatgtgtaccgctggccgatcatcagtctttgaaccatgcggatgtcagtgcgttggtaagcgccgggcaaacgctggtaatgactgaaaaagatgcggtgaaatgccgggcctttgcagaagaaaattggtggtatttgcctgtagacgcacagctttcaggtgatgaaccagcgaaactgcttacgcaactaaccttgctggcttctggcaactagttacgccgcggcagcgttcgattgatggagtcatgaatgtcgctgccgcacctctcccttgctgatgcgcgtaatcttcaccttgccgcacaaggcctgttaaacaaaccccgccgtcgagcgtcgttggaggatattccggcaacgatctcccgcatgtccttgctgcaaatcgataccatcaatattgttgcccgtagtccatatctggtgcttttcagtcgtctgggaaattatcctgcccagtggctggatgagtctctggcgcgtggcgaattaatggaatactgggcgcatgaagcctgctttatgccgcgtagcgactttcgtcttattcgccaccgcatgctggcacctgaaaaaatgggctggaaatacaaagacgcctggatgcaggaacatgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctgactgggatgatgagcgcgatctcgtttcgcaaacagaagcagaaatcatcatgctggataacagtgcgcgtagcctgggaatattccgcgaacagtggctggcagattactatcggctgaaacgtccggcactggcggcgtggcgcgaagcgagggctgaacagcagcaaatcattgctgtgcatgttgaaaaattgggcaatctttggctgcatgatgatttgctgccgctactcgagcgagcgctggccggaaagctcactgcaacgcacagcgcggtactttcgccttttgatcctgttgtctgggatcgcaaacgcgcagagcagctttttgattttagctaccggctggagtgctataccccagcgccgaaacgccagtatggctattttgttctgccgttattacatcgtgggcaattagttgggcgaatggatgccaaaatgcatcgccagacaggcatccttgaagttatctctctgtggttacaggaaggtattaaaccaacgacaacgctgcaaaaagggctacgtcaggcgattactgatttcgctaactggcagcaggcaacgcgggtgacattaggatgctgcccgcaaggcctctttactgattgccgcaccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctcgctttcccgctgcgtgatggcattccagtgttgctggaaacggaagcccgcgtgctgactgctgatgagagtaaatcatgagttttgtggtcattattcccgcgcgctacgcgtccacgcgtctgcccggtaaaccattggttgatattaacggcaaacccatgattgttcatgttcttgaacgcgcgcgtgaatcaggtgccgagcgcatcatcgtggcaaccgatcatgaggatgttgcccgcgccgttgaagccgctggcggtgaagtatgtatgacgcgcgccgatcatcagtcaggaacagaacgtctggcggaagttgtcgaaaaatgcgcattcagcgacgacacggtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtatgcactgtacttctctcgcgccaccattccttgggatcgtgatcgttttgcagaaggccttgaaaccgttggcgataacttcctgcgtcatcttggtatttatggctaccgtgcaggctttatccgtcgttacgtcaactggcagccaagtccgttagaacacatcgaaatgttagagcagcttcgtgttctgtggtacggcgaaaaaatccatgttgctgttgctcaggaagttcctggcacaggtgtggatacccctgaagatcttgagcgcgttcgcgctgaaatgcgctaatttcacttcacgacacttcagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtacgcccggaaaagcccgacaactggcatggaaaaccaccatgctggcaagaagtgggactgtccgtatgccgactatttatggtgtgatgacgcatgaagaacaccccggccccgatgtcctgctactggagcggatgcgtggtgtttcggtggaggcaccagcccgaacaccagaacgctgggaacaactcaaagaccaaatcgttgaagccttactggcctggcaccgtcaggacagtcgcggttgcgtcggcgcggtcgacaatactcaggaaaatttctggccctcatggtaccggcaacatgttgaagtgctatggaccacgctcaatcagttcaataacaccggtctgacgatgcaggataagcggatcctgtttcgcactcgcgaatgtctcccggcattatttgaaggctttaacgacaattgtgtgctgattcacggtaacttctgtttacgcagcatgttgaaagattcgcgcagcgatcagttactggcgatggtcgggccgggactaatgctttgggcaccgcgagaatacgaactgttccgactaatggataattctctggcggaagatttgctctggagttacctgcaacgcgcgccagtggcggagtcgttcatctggcggcgttggttgtatgtgttatgggatgaagttgcgcaactggttaataccggacgatttagtcggcgcaacttcgatctggcatcaaaatcactcttgccgtggctcgcctgacgaaccttttagccactgccagatacggccaagcgtttcatagccaacacgatcgctatgcatcaaccagaccggagaagggattgcccgttcccacgggttaagcggcgagtcgatggccaactgattcgccggggctggtagcggatttaacccttcctgctgaaaaaagatcatcgcccgcggcagatgtgatgcggaggtcaccagcaggaaaggggcgtcaccaatcgcctgtttcactgctgcagcttcttcttcggtatcttttggcaaatccagggtgataatttgctcgcgcggcacgcccagcgattgcgcaactctggcacctacttccgctgtactcaccgtattggtttttgctacgcctcccgtgaagatcagttttgatcccggattttcgcgccataagcgaataccttcattcaggcgtggcagactgttattgattaaattagagctcggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttaaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgtgggcatcaggtcattttatgcgatctttctgcgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggctgatccccgcagcgtattgcagaccctctggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggacgctttcgccagattatccacgcgacccggcgcaggtttatctgtggctggaagaagctggttggcaaattatgggtaagacaggcgttcgcgtgtttcatgattatctgcgcgagaaacaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgccatgtgagtgatgcgtttgagcaaaccagcgaaaccatcggcgtgcgcgccaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtggcgggtgagctcaaacgcgcagcagatgccgccgaagagggcggtgatgaatttcactggcaccgtaatgtctatgcgccactgaaatattcggtagcagaaattttcgacagtatcgacctgacgcaacgtctgatggacgaacagcagcagcaggtgaaggacgatatcgcccagttgctgaacaaagactggcgggcggcgatttccagctgtgaattgttgctttcggaaacttccggaacgctgcgtgaattgcaggatacgctggaagcggcaggcgacaaattgcaggctaatctgttgcgcattcaggatgcgacgatgacccatgacgatctgcatttcgtcgatcgtctggtgttcgatctgcagagcaaactcgatcgtattatcagttggggccagcaatccatcgacttgtggattggctacgaccgccacgtacacaaatttattcgtaccgcgatcgatatggataaaaaccgcgtctttgctcagcggttacgtcagtcggtacaaacctattttgatgagccgtgggcgctaacttatgccaatgccgatcgtctgctggatatgcgtgacgaagagatggcactgcgcgatgaagaagtgactggggaacttcctgaggatctggaatacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgtattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggacagcgccttacgttcaggacgccatattggcctcgacgaactggataatcatgcattcctgatggattttcaggaatatctggaagagttttacgcgcgttataacgttgagcttattcgcgcaccagaagggttcttctatttacgcccacgttccaccacgctgatccctcgttccgtcttgtcggaactggatatgatggtcgggaaaatcctctgttatctctatctcagcccggaacggctggcgaatgaggggattttcacccagcaggaactgtacgacgaactgctcaccctggccgatgaagcaaaactgctgaaactggtgaacaaccgttcaaccggttcagacgttgaccgtcagaagttgcaggagaaagtacgttcttcgctcaaccgtctgcgtcgtttaggcatggtgtggtttatgggccacgacagcagcaagtttcgcattaccgaatcggtgttccgcttcggagccgatgtgcgtgctggcgacgatccccgtgaagcacagcgtcgcctgattcgtgatggcgaagcaatgccgattgaaaatcatctgcaactcaacgatgaaaccgaagagaatcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgctgatccccgacctgaccctgctgcatttccgtaacactacggaagccggggccaccagcggttcgcgcgataaaggtctgcacggtaagctgaaagcgggtgtctgttattcgatgctcgacaccattaactcgcgccaccagcgcgtggtggtcggtgtgcgtctgcaacaggttgccggacgcgatcgtaaagtggatatcaagccgtttgccattcagggactgccgatgtcggtgcagccgacacagctggtgaccgaaaccctgaacgaacgccaggcgcgcgtgctgccgcttaacgagctgaaagacaagctcgaggcgatggaaggcgtgcagtttaaacagttcaactccattactgattaccactcgctgatgttcgatctgggcatcatcgcgcgtcgtctgcgctccgcatctgaccgtagcaaattctatcgtctgatcgaagcttcgctgtatggcgggatctccagtgccattacccgttctctgcgcgactacctgttgccagaaaacagcggcgtgcgtaaagcgttccaggacatggaagcggcgctgcgtgaaaaccgtatgacgctggaagcgattcgtgtcacccagtcggaccgcgacctgtttaagcatctgatcagcgaagccaccaactacgtggcggcggactacatgcgtcacgccaacgagcgccgtgtccatctcgacaaagccctggagtttcgtcgcgagctacatacttcgcgtcagcaactggcggctgagcagtacaaacacgtcgatatggcgcgtgagctggcagagcacaacggtgccgaaggcgatctggaagcggattatcaggcggccagtgatcacctgaacctggtgcaaaccgcactgcgtcagcaggagaagatcgaacgctacgaagcggatctcgatgagctgcagatccgtctggaagagcaaaatgaagtggtggcagaagccatcgaacgccagcaagagaatgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgactgcgccgccgaatggctggaaaccttccaggcgaaagagctggaagcgactgaaaaaatgctctctcttgagcagaaaatgagcatggcgcaaaccgcgcacagccagtttgagcaggcttatcagctggtggtggcaatcaacggcccactggcgcgtaacgaggcgtgggatgtcgctcgcgaactattgcgcgaaggggtcgatcagcgtcacctggcagagcaggttcagccgctgcggatgcgattaagcgaactggaacagcgtctacgcgagcagcaagaagctgagcgtctgctggcagatttctgcaaacgtcagggcaagaattttgatatcgacgaactggaagccctgcatcaggaactggaagcacgcattgcctctctttccgatagcgtgtctaacgcccgtgaagagcgcatggcactgcgccaggagcaggaacagctgcagtctcgcattcagagtttgatgcagcgtgcgccggtttggctggcagcgcaaaacagtctcaaccagttgagcgaacagtgcggcgaagagtttacctccagccaggacgtcaccgaatatctgcaacagttgctggagcgtgagcgagaggcgattgttgaacgcgatgaagtgggcgcgcgcaaaaacgccgtcgatgaagagatcgaacgtttaagccagcctggcggctctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaactgaacacctggaaggcttgaccgattgcccggaagatctctatctgatcgaaggagatccgcagtcattcgatgacagcgtgttcagcgttgatgagctggaaaaagcggtagtggtgaaaatcgccgatcgtcagtggcgttattcacgtttcccggaagtgccgctgtttggtcgtgctgcgcgtgaaagccgtattgaaagcctccatgccgagcgtgaagtgctttccgaacgcttcgccacgctctcctttgatgtacagaaaactcagcgtctgcatcaggcgttcagccgctttatcggcagtcatctggcggttgcgtttgagtctgacccggaagcagaaatccgtcaactgaacagccgtcgcgtcgaactggagcgggcgttaagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgattgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctattctgactcggcagaaatgcttagcggtaacagcgatctcaacgaaaaactgcgtgaacgtctggaacaggcggaagcggagcgtacccgcgctcgcgaagcgttgcgcggtcacgcagcgcagttgagtcagtacaaccaggtgctggcttcgctgaaaagttcttacgacaccaaaaaagagctactcaacgatctgcaacgtgaattgcaggatatcggcgtgcgtgctgatagcggggcagaagagcgggcgcgtattcgccgtgacgagctgcatgcgcaactgagcaataaccgttcacgccgcaatcaactggaaaaagcgcttaccttctgcgaagcggagatggacaacctgacccgcaaactgcgcaagctggagcgggattactttgagatgcgcgagcaggtagtgaccgccaaagcgggctggtgtgcggtgatgcgcatggtgaaagataacggcgttgagcgccgcttacaccgtcgtgagctggcttatctctccgctgatgatttgcgttccatgtcggataaggcgttaggtgcgctgcgtctggcggtggcggataacgaacatctgcgcgacgtgctgcgcatgtcggaagatccgaaacgtccggagcgtaaaattcagttcttcgtggcggtttatcagcatctgcgtgaacgtattcgtcaggatattattcgtaccgatgatccggtggaagctatcgaacagatggagattgaacttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggtcaggtgaacagcgtgcgtctcaacgtgaacgtgcgtgaaacgcacgccatgctactggatgtgctctctgaacagcacgagcagcatcaggatctgtttaacagcaaccgtttgaccttctcggaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggctgcgcgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggatgctcgttctatcgccacgctgtttgaattgtgtgagcgtttgcaaatgcaactcatcatcgcagcgccggaaaatatcagcccggagaaaggcaccacctataaactggtgcgtaaagtcttccagaataccgaacacgttcatgtcgtcggcctgcgaggatttgcgccgcaactccctgaaacgcttccaggaactgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcagctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggcagaaaaagcccgcacgcaaatcgaatctcaattacccgcaggttacaagccggtttatcttaaccagcttcaactgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatggcacgcgacgtggtgctctctgatgcgatgatgggctatctccatttcattgcaaatattccggtcaaaggcactcgctggctatatagcagtaaaccttatgcacttgcaacgccgccgctctcggtgattaaccaatggcagctggcgctggataaaggtcaattgcctacgtttgttgcaggactggcaccgcagcatccgcaatatgcggcgatgcatgaatcgttactggccttactctgtgacaccaaaccgtggccccaactgaccggcaaagcaacgttgcgcccagggcagtggagtaacgacgtaccggcgttgcgcgaaatattgcaacgcacaggcatgttggacggggggccgaaaattactctacctggcgatgacacgccaactgacgcggtagtcagcccatccgctgttactgttgaaacagcagaaactaagccgatggataagcaaacgacgtctcgtagtaaacctgcgcctgccgttcgcgccgcctacgataatgaactggtggaagccgttaaacgttttcaggcatggcaaggattgggggcagatggtgctattggcccggcaacacgtgactggttaaacgtaacgcccgcccagcgtgctggtgtgttggctctcaacatccagcgattgcgcttgctgccaacagagctttctaccgggatcatggttaacattccggcctattcgctggtctactatcagaacggcaatcaggtgctggattcgcgagtcattgtcggtcgccccgatcgcaaaacgccgatgatgagcagtgcccttaacaacgtagtggtaaacccgccgtggaacgtacctccaactctggcacgcaaagatattctgccaaaagtgcgcaacgatccgggatatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggtgatacacgttacgtcaatattcggcagtcgattccggtgaatctctactacctgacggcctttgttggtgcagatggtcgtacccagtatcgtacagatatttacaattatgatctgcctgcgcgatccagctcgcaaatcgtatcgaaagcggaacaattaatcaggtaaatgaagtagttcggggaaatcagttgtcgtaataattagcatgattgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaattgctggcgcttggtggcgttgcactcggtgccgccatcctgccgacccctgcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacgcgcaaaccggtgcaactcatttccggttatcgttctattgataccaacaatgaactacgcgcccgcagccgtggagtagcgaagaaaagctatcacactaaaggccaggcgatggatttccatattgaaggtatcgcgttaagcaatattcgcaaagccgcgttatctatgcgcgcaggtggtgtaggatattatccacgtagtaactttgtgcatattgataccgggccagcacggcactggtagtaattgcttaacgaaacaggggcagtatgaactatcgtattattccggtcaccgcattctcccagaactgttcattaatctggtgtgaacaaacccgtctggccgcactggtcgatcctggcggcgatgcggaaaaaatcaaacaggaagttgatgacagcggcctgacactgatgcagatcctgctgacgcatggtcatctggaccacgttggcgcagcggcggaactggcgcaacattacggcgtgccggttttcggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgatgttattttcaaaggcggagtagggcgcagtgacttcccgcgtggcgatcataatcaactgatttcttcaatcaaagataaattgctgccactgggggatgacgtgatatttattccgggtcacggaccattatccacacttggttatgaacgcctgcataatcccttcctgcaagacgaaatgcccgtctggtaaggcacataaaaaagcccgcttttaatgctggcctggatttctggcaaagtgcgctttgtttatgccggatgcggcacgagcgccttatccggcctacaaaatcgtgcaaattcaaaatattgcaggggacgcgtaggcctgataagcgtagcgcatcaggcaatgttgcgtttgtcatcagtctcagcccgcttttcagcgggcttcattgtttttaatgcttacagcactgccacaatcgcttcgcacagcggagccatgttatctggtgtcatcccggccacatttacgcgaccagaagcaaccgcatatacgccaaactcttcgcgcagacgcagcacttgttcttttgtcaggccactgaaggagaacatgccgttctgtttgatgataaagctgaagtcgcggtttgcgcctttttcctgcagcgtattgacgaacaactgacgcatacgctgaatacgctggcgcatatcagtcagctcttgttcccaaatcgcacgtaacgcatcgttgctcaggatggtggcaacaacagaagcgccgtgtgctggtgggttagagtagttagcgcgaatcgccgctttcatttggctgaatgcgcgatcaacggtttcactgtcggcagcaaccagagtacaagcgccaacacgctcgttgtacaggccaaagtttttagagtaggaactggcaacaatcagctctttatgcatagccgcgaaagcgcgcagtccttcagcatcttcttccagaccacgggcaaaaccctggtaagcgaagtcaaacagcggtaaccagcctttctcaacggagagttgtgccagtgtttgccattgttccagcgtagggtcgataccggttgggttatggcagcagccatggaacagcactacgtcgccagcctgagcttcattcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccccccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttgcccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagggaagtccgctatcagggtaacgggagatttacaaaattccaactattactgatgaaaacgcaggctgtttttgcaagacgtgagattgctctggaaggtataaaaaaaacaggaccaaagtcctgttttttcggcatttaacaaagaggtgtgctattagaactggtaaacgatacccacagcaacggtgtcgtctgaacctacgcccagtttgttgtcagaatcgatctggttgatgatgtagtcaacataggtggacatgtttttgttgaagtagtaggttgcgcccacttcaaagtagttcaccagatcaacatcaccgataccttctacgtctttcgctttagatttggtgtaagcgatggacggacgcagaccgaaatcgaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcgtacttcagaccagtagcccactgttcagcttttttaccgttgccaagaggttgagcttcttgcaggttggtacggtcagctgcaccataagcaccaacgataccaaagccttcgtattcgtagctgatagaaccgccaacaccgtcgccgttagaacggcgtgcagtgtcacgctcgtttttacccaggtactgaacagcgaagttcaggccatcaaccagaccaaagaagttggagttacgataggtagcaacgccgccaacacgaccaacgaagaagtcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccttcagagttgttaccctggaagttatattcccactgaccataaccggtcagatcggaattgatttgagtttcccctttaaaaccaagacgggcataggtcatgtcgccattgccaccgtaactgttttcaccgttacccttggaaaaataatgcagaccaacagctttaccgtacagatctactttgttgccatctttgttatagatttctgcagcgtttgcagtacctgctactaacagagcagggacgatcactgccagaatattgcgcttcatcattatttattaccctcatggttttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttggtttcaaaaagaaaaaatatgtaaccaaaagtaaaatttaaggaactttgtgaacaccgtcatatttccatagagacgtgatgatatttacagcaattttaatctatttatatgatttccttatatttaaattaactaaacggaaattttgtttctgatggaaactttatcgacctggcacaaaatcttctttcagacatccagaatgccaaaaaatagtatgaaaattgtgctattagctaagaaaaaactaatccgcaataagaatgcggattagtttttgcgcgtaaatgttgcaatgtaatattccgtaacaggatgatcgttatggcggggttgcaaatagattgcttgacttaacaaacagataacttgacagaaaagataaaaaaagagccagcgggcgctggctcttgaagacgctaaattagaagctggcgttacgcggagtacgtgggaacggaatcacatcacgtacgttttgcacgccagttacgtaagcaatcagacgttcaaaaccaagaccgaaacctgaatgcggaacagtaccgtagcgacgcagatcgcgataccaccagtaatcttctttattcaggcccatttccagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcgactccccagtaaaccgggttttcaaacttcctgccgcagttttcgagaatggtcactgcgtcggtataatccacctgcgcaaaatcggcttcaatgaagcgttccagacgtgaaacggcatctttatctacgcgttcagcgaagaatttcatgtcgtcagcgcgttcttcgagaaccgctttgaagacatatttcagcatggcttcagccagacccgcaatatcgttcaggttagcaaacgccacttccggctccagcatccagaattccgccaggtgacggctggtgttggagttttcagcacggaaagtcgggccgaaggtataaattttggacaatgcgcaagcgtaggtttcgccgttcaactggccagatacggtcaggaaagactctttaccaaagaagtctttgtcgaaatccactttgccctgatcgttacgcggcaggttttccagatccagcgtagaaacgcggaacatttcgcctgcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaggacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacacggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcatggcagatagttttgccagggctgtcagaaagtttcgccaccggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatgacgcaggccctgataccgactagcgaactcgacaccgaaatcacgcaggaaagcatccatagtgatgcagtcggttaatgcaatgccaagttggtcgggatactcttccagccaggcagcaagtgcagctcgctggctgttggctagatccgggctgatttgctgatgtgcctggaaccattcgtgtgcctgtgttcccatcggcgtgagggaaagccgacgcgccagatcgtagttgctggtgcccacaaaccaggattcctgttgcagacgcttaacgatggtttcttgtacttcgcgagaaaaacggcgacgggtgccaaaatccatcagatggaagcgcgacatatcaagaccggcggttaacgccgagaagtcgactaatttgctttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtaaccagttaagatagtcggccttaaagaaaggcagggcagaaagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcattacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctcgacgcgcaaaagacggtcgttaccgcggtcagccaggctgtccgtcatggtgcatcagatgctccccttcgtctcaacggcgaagacctcaaactggtttctgttcatattaatgatgagccgtggaccgcctggaaagaagaagagggcgcactggttatcagtaatttgccggagcgttttacgcttaagatcattaatgaaataagcccggcggcgaataccgcgctggaagggctttatcagtcaggcgatgcgctttgcacccagtgtgaagccgaaggtttccgccatattacgtattatctcgaccgcccggacgtgctggcgcgttttaccaccaaaattattgccgataaaatcaaatatcccttcctgctttccaatggtaaccgcgttgcgcaaggcgaactggaaaacggacgccattgggtacagtggcaggacccgttcccgaaaccgtgctacctgtttgcgctggtggcaggcgactttgatgtactgcgcgatacctttaccacgcgttctggtcgcgaagtagcactggagctgtacgtcgatcgcggcaaccttgatcgcgcgccgtgggcgatgacctcgctgaaaaactccatgaaatgggatgaagaacgctttggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggtaaccgagtgacctgtcgcgactggttccagctcagcctgaaagaaggtttaaccgtcttccgcgatcaggagttcagctctgaccttggttcccgcgcagttaaccgcatcaataatgtacgcaccatgcgcggattgcagtttgcagaagacgccagcccgatggcgcacccgatccgcccggatatggtcattgagatgaacaacttctacaccctgaccgtttacgagaagggcgcggaagtgattcgcatgatccacaccctgcttggcgaagaaaacttccagaaagggatgcagctttatttcgagcgtcatgatggtagtgcagcgacctgtgacgactttgtgcaggcgatggaagatgcgtcgaatgtcgatctctcccatttccgccgttggtacagccagtccggtacaccgattgtgaccgtcaaagacgactacaatccggaaaccgagcagtacaccctgaccatcagccagcgcacgccagccacgccggatcaggcagaaaaacagccgctgcatattccgtttgccatcgaactgtatgataacgaaggcaaagtgatcccgttgcagaaaggcggtcatccggtgaattccgtgctgaacgtcactcaggcggaacagacctttgtctttgataatgtctacttccagccggtgcctgcgctgctgtgcgaattctctgcgccagtgaaactggaatataagtggagcgatcagcaactgaccttcctgatgcgtcatgcgcgtaatgatttctcccgctgggatgcggcgcaaagtttgctggcaacctacatcaagctgaacgtcgcgcgtcatcagcaaggtcagccgctgtctctgccggtgcatgtggctgatgctttccgcgcggtactgcttgatgagaagattgatccagcgctggcggcagaaatcctgacgctgccttctgtcaatgaaatggctgaattgttcgatatcatcgacccgattgctattgccgaagtacgcgaagcactcactcgtactctggcgactgaactggcggatgagctactggctatttacaacgcgaattaccagagcgagtaccgtgttgagcatgaagatattgcaaaacgcactctgcgtaatgcctgcctgcgtttcctcgcttttggtgaaacgcatctggctgatgtgctggtgagcaagcagttccacgaagcaaacaatatgactgatgcgctggcggcgctttctgcggcggttgccgcacagctgccttgccgtgacgcgctgatgcaggagtacgacgacaagtggcatcagaacggtctggtgatggataaatggtttatcctgcaagccaccagcccggcggcgaatgtgctggagacggtgcgcggcctgttgcagcatcgctcatttaccatgagcaacccgaaccgtattcgttcgttgattggcgcgtttgcgggcagcaatccggcagcgttccatgccgaagatggcagcggttacctgttcctggtggaaatgcttaccgacctcaacagccgtaacccgcaggtggcttcacgtctgattgaaccgctgattcgcctgaaacgttacgatgccaaacgtcaggagaaaatgcgcgcggcgctggaacagttgaaagggctggaaaatctctctggcgatctgtacgagaagataactaaagcactggcttgataaataaccgaatggcggcaatagcgccgccattcggggaatttacccctgttttctcaggcgagtttcagattcaccacgttgcatcacccgttgcaacacctccgcttccagctccgctaatcgcaccgaccctaatcgacgcggacgggggatatccactgtcaaatccagaccaatttttccctcttcaattaacagcacccggtcagccatcgctaccgcttcgctcacatcatgcgtcaccaacagtacggtaaagccgtgctcctgccaaagtgacacaatcaaatcctgcatctcgagtcgcgttaaggcgtccagcgccccgagcggttcatcaagcaacaataatcccggtcgatgaatcaacgctcttgccagcgccactcgctgtttctgcccgccagaaagtgcggcaggccattcccctgcgcgattctccagtcctaccgcagccaacgctcgacgtgcggcatcgcgccactggcctttaaggcctaacccaacgttatcaatcaccgatttccacggtagcagacgcgcatcctgaaacatcattcgcgtgtcttcctgaatttcagccagcggtgtggtgcccgctaacacatcgcctgcggttggcgtttccagacctgccagcaggcgcagcagggtacttttgccaccaccgctgcggcccaccaccgccacaaactgacctgccggaatatgtaaatccagttggttcaggacgatattttccgcgtaatgtttgcttactgcattgagcaacaatggcgtgccctggttcagacgagcagtattcataccgtggcctccttcaaatgataagccgggttccagcgcaaccagaggcgctctaacagctgcgcgctgacgtcagccagtttgccgagcagggcgtaaagaataatagcgactaccaccacgtccgtttgcaaaaactcccgcgcattcatcgccagataaccaatgcctgaattggcagaaatggtttcggcaacaatcagcgtcagccacatcaggcccaacgcaaaacgcacgccgaccataattgagggcagggcaccaggcaggatcacatggataaacagcggtatgccggataatccatagctacgcgccatctccaccaacccgcgatcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaattgaggtatccagcagccgttctccccagcgagatagcccgctaatcagtcccaaaatcaaccccagcgatccgccaattgaaaagccaatcagcgcccgccaggagctgatcgccagatgctgccacagttcgccgctggcggagagcgtccagaacgccgtcaccactccttccggtgaaggcaaaatacgcgtcgacagccagccaaccgaggaggccagttgccacaccgccacgatgcccaccggtaaaaaccagggggcaacgcgcaataaccacttcttcactggcgttgccattatttcttccttagctttgcgcgactttacgggggataaaatcattcgccaccgcttcgccttgcggattcagcggctgcggctggggaatttccgggatggcgacatccagaagcgggaacagcaactcgccaacccgatacgcttcttccagatgcggatagcccgaaagcacaaaactgtcgatgccaagcgcggcatattcgttgattcgcgcagcgaccgtaggaccatcgcccaccagcgccgtcccggcaccgccgcgcactaagccaacgcccgcccataaattggggctgatctccagattgtcgcgcttgccgttatgtaacgccgccattcgctgttgccctacggaatccgtccgggcgaatgcggcctgtgctttggcgatagtttcatcatcaagatgcgagattaaccgctcggcggcctgccacgcttcgtcgttagtttcacgaacaatcacatgcagacgaataccgaaacgaattttgcgtccatgcgcggcagctttcgcccgcacttgttcgattttctctttaaccagttccggcggttcgccccaggtgaggtagagatcaacctgttctgccgccagctcctgggcgacatctgacgatccgccaaagtaaagtggcggatacggctgttgaatcgccgggaagagcagttttgctccgcgcacatgaatatgtttaccgttgaaatcgacggtttctctctgcaataaacgccgccagacctgggtaaattccgccgaggcttcgtagcgctcgctatgatcaaggaacactccgtcgcctgccagctcttgtggatcgctgcctgtgaccaggttaaacaacgcacgtccatttgagagacggtcaagcgtggcggcctggcgggcggcaacggtaggtgaggttacgctgggacgcagggcgacaagaaacttcagccgctgcgtcaccgggatcatcgatgcggcaaccagccacgcatcttcgcaggagcgccccgttggaattagcacaccggtatagccaagacgatccgccgcttgcgcaatttgttgcagataaccgtgatcaaccgggcgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacgattttcataaaacagatctgccgtttgctgctgtaaggcggcaacctcggcgttaaccggtttgatggtggtaggagggcgatgatctaagtaagaggcaatcaccggtgccggtaagcccatcgtttttgccagtaaagcgatgctttgctcgcgctggctgcgggttaacgcatcggcctcactaaaggttgccagtacgccctgaataaaagcgccgtttttttctgcatagggacgagctgccagataaaacgatccagtttgattgagatcggtgccgtctttcagcacccgcacgccgccctgtaataatgcagcagagtagtagggatcccagatagcccaggcgtcaacgttaccttgctggaacgcggcgcgggcatcagcgggcgtcaggtaagtgggttggatatcggtaaacttaagtccggcctgacgcagtgcacgcagtaaaaggttgtgtgaactggaacctttctgaaaggcaactttgtgacctttaagatcggctacggttttgatcgggctgttttctgccaccagaatcacttcggctttgggcttcggtggctcgacgcccacgtacaccaaatcagccccggcagcctgggcaaagattggcggaatatccccggtactgccgagatcaatactgccaacgtttaacgcttccaacatttgcggacccgcggggaactccacccaggagatttttgattccggatagcgtttttccagtaactggtggctttttgccagcaccataccaatactgcctttctgatagcctatacgtaacgcttcaggcgaggattctgcagcaaccgcaaaagtagagacgctaagcaatcccgccagcgccagtttaatgatgttacgcatgggcattacctcgcagagacagaaggtcaggaacctgaacatcgcggcggtgcaatgcctgccagaaagtttctagcgcggtatcaagacgggtttgcagatttggcgtgaactggggtctgtgatggtaatcaattacttgtgagtcatcggcaaacacgccgtgcaggatctcctgagctttcagtgcgcttaaaactggtttaagggcataatcgaccgccagcagatgggccacggtaccgcccgtcgccagcggtagcaccactttgccttgcaaagcgcgttctggcagcaggtcgagcagggttttcaacgcaccggaataggcggctttatacacaggcgtggcgacaatcagcccatcggcctgttgcagctgttcggtgaaggtcttgagtgccggactatcgaaacgagcataaagtagatcttccggggcgaagttttgcagattccagtgataaacctctacatccaggccatttagtttttcccgcgcatattccagcaaggagctggagcgagaaggaaagcgaggactacccgccagggtgatgacacgcatactctctccttataaccaattgttctttttttgttaacattgataacaattcggtcagtctgtcggagagacaagaaaattccaaatataaattttgtgtatctttttctgaaaataaactaaagaaagggctttatatatcacgcatatttatttattggatagtcattagatgttgaatcaatgaattactcgttcagttaatatttaaatattcatgaaatctataaattaaagatttgtcacttattggatttagtatgcttgatttaaatggcggacaattattgttattattaagtctaatgtcatttaaaggcattatcatatttacgaagagatcaggatgataacgatgaaaaaaagtgtattgacggcgtttataactgtggtatgtgcaacgtccagcgttatggctgctgatgataatgctatcacggatggctcagtaacatttaatggtaaagttattgctccagcttgtaccctggtagctgcgacgaaagattccgtggtgactttgccagatgttagtgccacgaagttgcaaaccaatggtcaggtttctggcgtgcaaattgatgtgccaattgaattaaaagattgtgatactaccgtaacaaaaaatgcaacgttcacctttaatggcactgcggatactactcagattacagcgtttgctaaccaggcctcatctgatgctgctacaaacgtggccctgcaaatgtatatgaatgatggtacaacggccatcacgccagacacagaaaccgggaacattttgttgcaggatggagatcagacgttgacttttaaagttgattatatcgctacggggaaagcgacttcaggtaatgtgaatgcggtaacaaatttccatattaactattattaatagaactcattaattgttttattaattagtacccctccagtgttctggaggggatattcatattttttaagagtgactatttatgaaaacttgcataacaaagggaattgtgaccgtaagtttaacggcaatattactcagctgctcatccgcatgggcggcaggtaaaggcgggattggacttgcagcaacacgtcttgtttattcagaaggtgaagagcaaatttcactgggtgtacgtaacaccagtccggatgttccttatcttattcagtcatgggtgatgaccccagataataaaaaatcagcagactttattattacaccaccgctatttgtgctgaatccggcaaatgagaatctgttacgcattatgtacattggagcgccgttggcgaaagacagagaaacccttttcttcactagcgtacgggcagtcccttcaacaacgaagcggaaagagggaaataccctgaagattgccacacaaagcgtcatcaaacttttctggcgaccaaaaggtttagcgtatcccttaggcgaggctccggcgaaactgcgttgcacttcgtcagctgacatggttacggtcagtaacccaacaccttatttcattaccctgacagacctgaaaataggtggaaaagtagttaaaaatcaaatgatttccccctttgataaataccaattttctctgccaaagggggccaaaaatagcagcgtaacgtatcgaaccatcaatgactacggggcggaaacgccgcaactcaactgtaaatcgtaagccgtcttcagttaagagagcgagatgtatagaactcatcgacaacacagcctgttaagctctggtggagtgccatcgtttattggtgggctggtggtgtttgtgtcggcagcgttcaatgcacaagctgaaacctggttcgatcctgcttttttcaaagatgatccctcaatggtggccgatttgtctcgtttcgaaaaaggacaaaaaataacgccaggggtttatcgtgtcgatattgttctgaatcagacaattgtagatacgcgcaacgtcaattttgttgagataacgccagagaaggggattgccgcctgtttgacgactgaaagcctggatgcaatgggtgttaatactgatgcgtttccggcttttaaacaactggacaaacaagcgtgtgtgccattggcggagattattccggatgccagcgtaacgtttaatgtgaataaactccgtctggaaatttcagtaccgcaaatcgccatcaaaagtaatgcccgtggttatgtcccccctgaacgttgggatgaagggatcaacgcgctattactgggatattcgtttagcggggctaacagtattcatagcagcgcagacagtgattctggcgacagctattttctgaatttaaacagtggcgttaatttaggcccatggagattgcgcaacaattcaacatggagtcgtagtagtggccaaaccgcagaatggaagaatctcagcagctatttgcaacgggcggttattcctctgaaaggcgaactgaccgtaggtgatgattatactgcaggcgattttttcgatagtgtcagctttcgtggtgtgcagctggcgtcagatgacaacatgctgccagacagcctgaaagggtttgcgcctgtggtgcgtggtatcgccaaaagcaatgcccagataacgattaagcaaaatggttacaccatttaccaaacttatgtatcgcctggtgcttttgaaattagtgatctctattccacgtcgtcgagcggtgatttgttagttgaaatcaaagaagcggacggcagcgtcaatagctacagcgtaccgttctccagtgtgccattactccagcgtcaggggcgaatcaaatacgcggtgacactggcgaaatacagaaccaatagtaatgaacagcaggagagcaaatttgcccaggccacgttgcagtggggcggaccgtggggaacgacctggtatggtggtggacaatatgctgaatattaccgtgccgccatgtttggtctgggatttaacctcggcgatttcggagcaatttcgttcgatgcgacccaggcgaagagtacgctagcagatcaaagcgaacataaaggtcagtcatatcgttttctgtatgccaaaacgctcaaccacttgggcactaactttcaattgatgggctatcgctattcgacgtcgggtttctacaccctttccgacaccatgtataaacatatggatggctacgaatttaatgacggtgatgatgaagatacgccgatgtggtcgcgttattacaatttgttttacaccaaacgtggcaaactgcaggtcaatatctcccagcaattaggcgagtacggttcgttttatttaagtggtagccagcaaacttactggcatacggatcaacaggatcggctattacagtttggctacaacacgcaaattaaagatctttcgctggggatttcctggaactacagtaagtcccgtggtcaacctgatgctgatcaggtgtttgctctaaatttttccctgccgctcaatctgttgctccccagaagtaatgatagctataccaggaaaaaaaattacgcctggatgacctctaacaccagtatcgataacgaagggcacactacacaaaacctgggtttaacggagacattactcgatgacggtaacctgagctacagcgtgcaacagggatataacagcgaggggaaaacggctaatggtagcgccagcatggattacaaaggggcgtttgcggatgcccgagtgggctacaactacagcgataacggcagtcaacaacaactgaactacgctctttcaggcagtttagttgcccattcacagggcattaccctggggcaatcgctgggggaaactaacgttctgattgcagcaccaggcgcagagaatactcgtgtggcgaacagcaccgggctgaaaactgactggcgcggatataccgttgttccttatgccacttcttatcgggaaaatcgaatcgcacttgatgcggcgtcgttaaaacgtaacgtggatcttgaaaatgcagtagtcaacgtggttcccaccaaaggggcgttggttctggcggagttcaatgcccatgcgggtgcaagggtattaatgaaaacatcaaagcagggtataccgctgcgttttggcgcgatagcgacgctggacggcgtacaggctaatagcggcataattgatgatgatggctcgctctatatggcgggtttaccggcgaagggaacaataagcgtgcgctggggcgaagctcccgatcaaatttgtcatatcaattacgagcttaccgaacaacaaattaactctgcgattacgcgaatggatgccatatgcagataatctttggagaaaaatgcgtgtcattactacgactattttttgccgccgtcttaatgttatggtgcgctcaaaccgctgcttatagcgggcagtgtcatactactcaggggaatccgtatattggcgtcaattttggcgttaaaaccctggaggaagaagcaaatacggcaggggtagttaaagacaaattttatcagtggaacgaatcgaatgattattatgtttcctgtgattgcgataaagacaatgtcagaagtggccgatgggcattcgccgcggattcaccgttagtctatttaggcgacaactggtacaaaattaatgactatcttgccgccaaagttttattgcaggttaaaggcagttctcctactgcggttcctttcgaaaacgtgggcacagggggggatacccgatggcatatttgcgaccctggcggtcaacgtttaggtgggcagggggcaagcggtaatagcggtagcttttccctgaaaatattgcagccgttcgttggctcggtcgtcattcctcctatggcgctggcgcgattatatgaatgctacaacatacccgcaggtgattcctgcacgactacaggtacaccggttttagtgtattacctgtctggtacgatcaattcacttggctcatgttccgtcaatgccggagagacaattgaagttgatttaggtgatgtcttcgctgccaatttccgtgttgtagggcataaacctcttggggccagaacggcagaacttgcaattccagtcaggtgtaacacgggaaacgcgggattagttaatgtcaacctgagtctgacggcaaccacagaccccagctatccccaggcgattaagacgtcacgtcctggcgtgggcgtggtggtgaccgatagccagaacaacattatttcccctgctggtggaacattaccgctctctattcctgatgatgcagacagtatcgcgcgaatgaatgtctatccagtcagcacgacaggtgtaccaccagaaaccgggcgatttgaagccacggcaacggtgagaataaattttgattaacgcgtgaacgtatgaagaaaaaaacgatatttcagtgcgttatcttgttctttagcattcttaacatccatgtcgggatggctgggcctgaacaagttagtatgcatatttatgggaatgtggtcgatcagggctgtgatgtcgccaccaaaagtgcattacaaaatattcatattggtgattttaatatcagtgattttcaggccgcgaataccgtaagcactgctgctgatttgaatatcgatatcaccggttgtgccgctggtattactggcgcggacgtcctttttagcggcgaggctgacacccttgcgccgacactgctcaaactaactgacacaggcggaagcggtggtatggcaacggggattgccgtgcaaattcttgatgcgcaaagtcagcaagaaatcccgctcaatcaggtccagcctcttacgcccttaaaagccggggataacacactcaaatatcaacttcgttataagtccacaaaggcgggagcaacgggcggtaatgcgacggcggttctctattttgatctggtttaccagtgaaggagtgatgttgaaacggataatctggattctgttcttattgggattaacgtggggctgtgagctatttgcccatgatggcacggtcaacattagcggatcgtttcgccgtaatacatgcgtgctggcacaggatagcaagcaaatcaatgtgcagttaggcgatgtctcgctgacacgtttttctcatgggaattatggcccggagaaatctttcatcattaatttgcaggattgcggaacagatgtcagcacggttgacgtcaccttttcaggaacccccgacggagtgcagagcgaaatgttgtccattgaaagtggtacggatgcagccagcgggctggcaattgcgattctggatgatgcgaagatattgattccgcttaaccaggcgagtaaagactacagcctacatagcggtaaggtgccattaactttttatgcgcaattgcgacctgtcaatagcgatgtgcagtcgggtaaagtgaatgccagcgcgacatttgtacttcattatgactaatacgtggaacagattggcgctcttgattttcgccgttttatcgctgctggtggcgggtgaattgcaggcaggagtggtggtcggcggaacgcgatttatctttccggcagacagagaatcgatatctattttactgactaataccagtcaggaatcctggcttattaacagtaaaatcaaccgcccaacgcgttgggccgggggggaagcgtcgacagtgccagcaccattactggccgctccgccacttattctcctgaagcccggtacgacaggcacgttgcgcttgctgagaacggaaagcgacatcttgcctgtggatcgcgaaacgctatttgagttaagcattgccagcgtgccatccggcaaagttgaaaatcagagcgtaaaagtggcgatgcgctcggtatttaaactgttctggcgacccgaaggtttgccgggcgacccgctggaagcttatcaacaattacgctggacacggaattcgcagggtgtacaactcactaacccaacgccttattacattaacctgattcaggtgagtgtaaatggtaaagcgttaagtaatgtgggagttgtgccgcctaaaagccagcgtcagacaagctggtgtcaggcaatcgcaccgtgtcatgtcgcctggcgggcgataaatgattacggcgggttgagtgcaaagaaggagcaaaatctgccctgaaacaggttcggaaaacgtttgcgttttttttgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaattatttcttcgaattcctctttataagataatcagggctttattttcagccctggttgttttatattcatcgctgttgcttatttagacattttgtacttttattgttgaggttattaagcgaagcgacaatggattgtgttgctgcggttttatagggtaggggagaggcagatgcgaattaaaccagacgataactggcgttggtattacgatgaagagcacgatcgaatgatgctcgatttagccaatggtatgctatttcgctcacgttttgcgcgcaagatgttgactccagatgccttttctcccgcaggcttttgcgttgacgacgccgcgctctatttctcttttgaagaaaagtgccgcgattttaatttatctaaagaacaaaaagccgaactggtgctgaatgcactggtagcaattcgctatctcaaaccgcaaatgccgaaaagctggcattttgtttcccatggtgaaatgtgggtgcccatgccgggcgatgcggcctgcgtttggttgagcgatactcacgagcaggtcaatttgctggtcgttgaatctggcgaaaatgccgcactatgcctgctggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccaacttaagtgcagtcttcggtacacagctacagcaaagaatggtgccatcatcgcccattgctgattttttcagcggcgtgacttcgccttctaaaagctgaacacggcaacttccacaaatgcccgcgcggcaagaataagggatacgaattccctgattttctaattgctccagcaacacctgttggttatttccacgaaatgcctgtccctgccagtcaatatctacatttgcgtccggttgttgcgtgatgttggcggtatcatcagcggcagctgcgccgtaaatttttgccggagccgttgccagaatttccacctcatcgccaacgcgaatcacgccgctattacgggcaattaaattctgaccaaaatcgacatcgccgttatcctgggcagtgcggaaagattgcaatgtttttaatggttcgcctgccggatgtttttgccctttttctgggctgacggtggtgaaaatacagcggctacaaggtttaaccacatcaaacaccacatcaccaatgcgaatcactttccagcgatcttcttcccaggctgacgcgccggaaaccaccagattggggcggaattgctccatttttacactggccggacaacgttgttggagatcacgtaacgaggcttcgttagcaagaaggtaaggatagccatcagcaaatgacagaggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcgctactgccatctggtgcggtgagatgcaagccatcatgcacaggtgaaggagtaaaccgtaccatctggggaaactggcgagcggtaataaacgtaccgtcaggttccgtgatcataaagatgcgatcgaaggccagaccactgacatctgccagagcatgtgtaagaccaatgccgcgcatcgatttaacaggatgaataaaaagccggattaatgtcgccacggtgcggtcctcaaatgaaaataagccctcaactttatgacatgacgcgcttattagctataatgcgcaacaattttcttagcgcctgtcccattaggctattttatttgtcagtttggccctgggttatgctcgaaatcctcacgtacttgtgtacgctccggtttctccgcgctgtccatgtccagactgactgcaacaattacgcctactgcggtaggctcttagagtaaaagtgacgatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatccgcaacagtcagtacggcgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgctcttgatctgagtggtgatggtttacatctgcgtggctatcgcgatcgtgctggtattgcgccgatcaaagaaaccctggcagccgctattgtgatgcgatccggctggcagccaggaacaccgctgctcgatccgatgtgtggttccggtacgttgctgattgaagcagcgatgctggcgaccgatcgcgcaccaggcttgcaccgtgggcgttggggctttagcggctgggcgcagcatgatgaagctatctggcaggaagtgaaagcggaagcgcaaactcgcgcccgtaaaggcctggctgagtatagctctcatttttacggttcggacagcgacgcacgggtgattcaacgtgcacgcactaacgcccgtcttgcggggattggtgaactgatcacctttgaggtgaaagatgtcgcgcaactgaccaatccgctgccgaaagggccgtacggcacagtgttgagcaacccgccatacggggaacgtctggacagcgaaccggcgctgattgcgctgcatagcctgctgggtcggatcatgaaaaaccagtttggtggctggaatctctctttgtttagtgcctcgccggatctgctaagctgcttgcagctgcgtgcagacaaacagtacaaggcgaaaaacggcccgctggactgcgtacagaaaaattaccacgttgccgaaagcactccagacagcaaaccggcgatggtagcggaagactacaccaaccgcctgcgtaagaacctcaaaaaattcgagaagtgggctcgccaggaagggattgaatgttaccgcctgtatgacgccgatctgccagaatataacgttgccgttgaccgttatgccgactgggtggtggtgcaggagtatgcgccgccaaaaactattgatgctcacaaagcgcgtcagcgtctgttcgatattatcgctgcaaccatttcggtactggggattgcgccaaacaaactggtgctgaaaacccgtgaacgccagaagggcaaaaaccaataccagaaactgggcgagaagggcgagtttcttgaagttaccgaatataacgctcacttgtgggtgaacctgacggattatctcgatactggtctgttcctcgatcaccgcatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggaatgggcagaacgcaacctgcgtctgaatggcctgaccgggcgtgcgcatcgcctgattcaggccgattgcctggcgtggctgcgtgaggcaaatgaacagttcgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgtggcttccgtatggatctcgacggcctggcaaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtgggccgcaacggcgcaggcaaatcgacgttaatgaaaatcctcaaccgtgaacaagggctggatgacggtcgcattatttacgagcaagatttgattgtagcgcgtctgcaacaggatccgccgcgtaacgttgagggtagcgtttatgatttcgttgccgaaggcattgaagaacaagcggaatatctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactggggttagatcctaacgttgcgctgtcgtcgctttccggcggctggttgcgtaaagcggcattaggacgcgcgctggtgagtaatccgcgcgtgctgttgcttgatgaaccgacaaaccacctggatattgaaaccatcgactggctggaagggtttttgaaaactttcaacgggacgattattttcatctcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgccgtacccgtaatgaaggccgcgtacgcgccctgaaagcgatgcgtcgcgaacgtggtgaacgtcgcgaagtgatgggtaccgcaaagatgcaggtggaagaggccagccgctccggtaaaatcgttttcgaaatggaagacgtttgctaccaggttaacggtaagcaactggtgaaagatttttctgcccaggttctacgtggcgacaaaattgccctgattggtccgaatgggtgcggcaaaaccacgctgctaaaactgatgctcggtcagcttcaagcggacagcgggcgtattcacgttggcaccaaactggaagtggcttatttcgatcagcaccgcgcggaactggatcccgataaaacggtgatggataaccttgccgaaggtaagcaagaggtgatggttaacggcaagccacgccacgtattgggctatttgcaggactttctgttccatccgaaacgggcgatgacgccggtacgtgcgctttctggcggtgagcggaaccgcttgctgctggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgttggatcttcgaaggcggcggtaaaattggtcgttatgtcggcggttatcatgatgcccgtggtcagcaagagcagtatgtggcgctcaaacagcctgcggtgaaaaaaaccgaagaagccgccgcggcaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccgcatgagcagacgcaaaaagtgcttgctgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttagtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgttaaactgatggcttacggcagcattggggtaggcagcagctttctcccctggtgtttattttgtgtcctgcaactgcgcgcttttcagtgcgttgatcgtcgctggttatgggacgacatcgccccgatgccagaactgcgccagccgctaaaaccaggcgtcacggggatacgtcaggggctgcgttcgtgctcctgttgtacggcaatccttcctgctgatgaacccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatctttctggccagtattatggtgccaacgttaaagatgatcgccatcgcgtggctgtgttgggatgccaaagggcatggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaaattgctgcataaagacaccgtcttttgggtggtgaaaccgcagattggtcgcgaagggattagcggcctgggaacgctgctgtctggagtttatatcgaactgcagccaggcgcgaaaggcagcaaaatggataaatacgatttgctggactcgccaccgttggccccgcctgatgcgaaaggtatccgtgtgattctcgatagcaaaaaagccgggcagctctcgccaggagatccggtgctgttccgtggctatcgggtaggttcggttgaaaccagcaccttcgatacacaaaaacgcaatatcagctatcaactgttcatcaatgcaccttatgaccgactggtgaccaacaatgttcgcttctggaaagatagtggcattgcggttgatctgacgtcagcagggatgcgtgtggagatgggctcattgacaacgctgctgagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagagttccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggtgcactgtatgttgatctcgatttctatccaaatacgcctgcaataaccggtattcgtgaatttaatggttatcagattatcccgaccgttagcggcggcctggcgcaaatccagcaacgactgatggaagcgttggataagatcaacaaactgccattgaatccgatgattgaacaggcaaccagtacgctttctgaaagtcagcgcacaatgaaaaacctgcaaacgacgctggatagcatgaacaagatcctcgctagccagtcgatgcagcagttgccgacggatatgcagtcaacgttgcgtgaattgaatcgcagcatgcagggcttccagcctggctccgcagcctacaacaagatggtggcggatatgcagcgccttgatcaggtgttgcgagaactgcaaccggtgctgaaaacgctcaatgagaagagtaacgcgctggtatttgaagcgaaggacaaaaaagatccagagccgaagagggcgaaacaatgaaaaagtggctagtgacgattgcagcactgtggctggccggatgcagctccggcgaaattaataaaaactattaccagttacctgtggtgcagagcggtacacaaagtaccgccagccagggcaatcgtctgttatgggtagagcaggtcactgttcctgactatctggcggggaatggtgtggtttatcaaaccagtgatgtgaagtatgtgattgccaacaacaacttgtgggccagcccgttggatcaacagttgcgcaacaccctggttgccaacctgagtacgcaactgcccggctgggtggttgcctcccagcctctgggaagcgcccaggacacgctcaatgttaccgtaacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccggtgtctggagtcaggaagccgcttctattgcacaagagataaagcgtctaccttaattataaagatttgtaaatataaccgtctccggtatgttgcctgaggcggtttttttgtctctaacgtgcggaaaaatttgttcctcttcacattttttgtacaaccgacatgcccgtgtagctcacaaatatgacagtggcgtgaattttgcgcattgacggcagttatgattcgcggtattgcttaactgtgattgcacatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgccttttgatactctgtctgattataatcagaaggcagacgtatcctggaacagaccgactttcaggtcgctggcggtatagatcagacgaccatcaaccagcacttcgccatccgccaggcccataatcagacgacggttaacaatgcgtttaaagtgaatacggtaggtcacttttttcgctgtcggcagtacctgaccagtgaatttcacttcgccaacgcccagcgcgcggcctttaccttcgccgcccagccagccgaggtagaaccctaccagctgccacattgcgtccaggcccaggcatcccggcataaccggatcgccaataaagtggcatccgaagaaccacagatccggattgatatccagttctgcttcaacataccctttgtcgaagttaccacccgtttcggtcattttgaccacacggtccatcatcagcatgttcggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgcgcgatacgttcctggatggtttgcatcagcgtcgtttggccttcgccatcccacaccagatttaataataacggcagtgcgtcagtcacatcgtctactgcccagatggtgaatttgccttcttctaccgctttcaccagttcactgtgaagacttaaatggcgaacgttagctgtggggataatgacaccttgtttcccggttaactcacgttgctggcaaatagcaaagaagccttcgattttctcatttaaaccaccgaccggctgggcgcgaccgaactgatcgactgaacctgtgatagcgatactctgattcaccggcacatcggcgagggcgcttatcagggcgcagagttcagccatcgaggcactatctccatcaacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaaggttcgccaaaagcgcgtggatgacccggaaattcaatgaccgaaagggcgttaatttgcccgatgcgttcgccttcggtttcaatcaggatttgctcctgaaggatctcatcctgcatacgttcagcgaggaaaccttcgcgccattcacgctgctgcagcattaagtttagctgctcgccggagaaggtgtcgccatcacacagggaggcgacctctttacactggcggaggatccactgcgggctaagcggaagtgtttcttgttcaccggtgtagcgtgctgcttcgcggataagtatcggccaggcatccgctcccggtgcaggtaagtgattatgtctggcggtaaatgtcacccagcgacaccactgggttactgactccgcatcgacaatctgcagagtatcttcaaattcgctataaatagcctgctctgaaagctctggctccatctcctggaaatcagccaatgattcgcgttcgcctaccagaatgactttcagcttcaatggcatcgaaggcacagagacggggagagggcgcgactcatcaaacgcaacccagtcaaaacgctcgcggttaacgatatttttcagccgcatccacagcagaggttgcgccagcagtgtacgcaaagagataatgagaataccgccatttgcctgatgcaccagaccaggctgcagggtaatgtcgccattaaactggcgcaggcagccaaagagttgctccgcttctacccagtcggcagcgacaacttgcgttaaagtcgcaaaattatcatctgcactcactgcgtgacgtaagcggatggagtggccggaaacctcatagtgaccgcccaccagttggcctgcatcgctttgtagcgtacgcgcggcattggcaataagattcagatactcagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattataccgtaaccggcactacagcacacgtagaaagcaccgacaatactcctggcatgggcgttaaagctcacaggatggagattcttttcttcactggcctaaaaagctgatattctgtaaagagttacacggtaacattgagatcgctatgaaatatcaacaacttgaaaatcttgaaagcggttggaaatggaagtatctggttaagaagcatcgcgaaggggagttaatcacccgttacatagaagccagtgccgcccaggaagccgtcgatgtgttgctctcgctggaaaatgaacccgtgctggtaaatggctggattgacaagcatatgaatccggaactggtcaatcgcatgaagcaaaccattcgggcaagacgaaagcgccattttaatgcggaacaccagcatacgcgcaaaaaatcgatcgatctggaatttattgtctggcaacgtctggctggtcttgcgcagcgtcgcggtaaaacgctttctgaaacgattgttcagctgattgaagatgcggaaaacaaagagaaatacgcgaataaaatgtcttctctgaagcaggatctgcaggcattgctgggtaaggaataactgacgaaagtcagttcaatttactaaaggcaaaaaaaaccccgcagcagcggggtttttctaccagacgagaacttaagcctgcggctgagttacaacgtctttgatacctttaacttcgatctctacgcgacgatccggagccaggcagtcgatcagtgcagcacgctgtttcacgttgtcacaggtgttgccagtaaccgggttggattcgcccataccacgtgcggagatcttgtctgccgggatacctttggagatcaggtaatcaacaacagactgagcacggcgctcggacagaccctggttgtaagcgtcagaaccgatgcggtcggtgtaacccagaacaactacggaaccgtctttcggatccaggttgctcagctggctgtacagctgatccagagcagcctgaccttccggtttcagggttgctttgttgaagttgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcgtactcaacaccgccagcgaagaccggagaaacgccggtgtcgtggtttttaccataaacgttggatttagtgtctgcacgccataccatgccacccagacgagtgtagatgtccaggtcgtcagtgattgggtaacccagtttagcggtcagttgaacgccctgagctttgtatgcaccgttttcaacgctgcctttgtacggcatacgacctaaccagtcgtaacccatttcaaagccaacatacgggttaacctggtaaccaccaaaagcaccagcgcccagttggttttcatgggtcgggccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtatgtttaatcttttttgtcagcgacaatttacagaagagaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgtggcgtgagaggatgcgcttaccggacgcataataaaccccatagcgttaccttcatttgccgcatcaacaagttcagcatgctcttcttcagtcaaatcatctgccaaccaaccgatcaccacactgtaattgcccgtgcgtaaagcgcgaaccattgactccacagtgtggcaaggggagagctggctaatctgcattactttcgttaagggtagcccagatgcctgaacccattcccgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgcggatgagaacgacgaagaacgatgtgcatagcctgaagtgtacataatcaatccagcccctgtgagttactgtatggatgtacagtacatccagtgacaacaaagatcaaccctattttcggaaagagcctcgcaaattttgtcgttggtgacgggaaaacataaattaatcttgccccttaagaataagttgcctattttcgtagttaacggatccgttaatgtgaatcattcttttatgttatgattttaaaaggaattttatgaaaagcctctcctataagcggatctataaatcacaagaatacctggcaacgttgggcacaattgaataccgatcattgtttggcagttacagcctgaccgttgacgacacggtgtttgcgatggtttctgatggtgagttgtatcttcgggcttgtgagcaaagtgcacagtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagcacgcgcaatacccgggaaagactgaaagatttgcccaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggtgccattatcggcattcatgaagctgcgctcccggtggcacgccgccaggagcttgcagaatgggctgactctcttacgccgaaacaggagtttcctgcggaacttgagtaatctggcgttgcagacgaccaatctcaggcagtaatgcaatcaataatccaacttgttgtacgaccagaggttctttgctgtctgcccgtggttcaagttgctgcatccgctgtttcaggctagctaatgcctcattgacgcgttcttcatcagcaggttgatgatgtaacgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggctcgctggacatatttgataccaccgacgccagctcagcatcacggttgtgtgcatcgcggcgggcaatacgatacgccagacggttatcacgcccctgatggtattgctccagtatggcatcgagataccgacagttggcctctgtggcgcgttcgagcatgcgcggcagattgcgaaactgccagtcaggccagatgtagctcactgccgcccacgcaatggcacaaccaatcagcgtatcgattacgcgaggtaacgctacttcaaaaccttcacccagtaagttaaaacacagtagcaccaaaagtgtgatgaacatcgttgcatgagcgtattgcacgttacggaaggcaaaaaagagcacgccggtaataaccagcagcaccagctgcccttccagtgatggcacaaaccacagcacaggaatgccaatggcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaacccgtgcgggctgtcatcagcgagctcattttcgtcattattatggggtagtgcctgggcctgttctgattcaattgttgccagttgggcatcaatggcgcgtaaattgttcagcaaaaatcccagtgttttgagtaaatcggcgggtgcgccgttatcgcgcatccgctccagcgcagcatcaatatgcgtaaaagcgcgctcaaaatgcggatcatgttgataaggctgacgcaacaaaatacagcgtgacagttgctggcacgcctggccctgcatcgacatcagccgctgaaaacggaacagcacgtcgctgtggcgaaaatgttcacgcaatgtttgatactgaatatgagaagagctggcacgctcgtgaatatcctgtgcgacaaagtaataatgcagcgtgcgacgcgttccccgttgaccacgatcgccacgtaagcgggtcagcagcgagagtttcgtctgattcaatgtcgccatcagcagaccgttggcgagagccaaatcgtacagcggtgcctggctttgatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagcagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatccccagcgttagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattcaaaacgacgacgtgcattggcttcacgcgcagcttgcgctgtttctaccgataccacgcgacgaccaaccggccatagtgcaatagcggcaattttaaagttcgcaatgccgacaggaatgccaatgattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcaggatcgtgtcagcggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggtgttttacgccagcaactggatttgattgccacgcgcactggggaaaataaatggctgacgcgtgagcaaacctctggcgtgcagcaacaaatccgccaggctttgtcggcgttgccgttgccggttaaccgactggaagaattcgataactgccgtgaggcgtggcgtaaatgtcaggcctggttgaaagatattgaaagcgctcggttgcagcataaccaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgcaggctggttgctggcgcgtggtgaagcgtcccctgagcaaattttattgctggcgtttggtcgcaaagccgctgaagagatggacgagcggattcgcgaacggctacataccgaagacattaccgcacgcacgtttcatgcgctggcgctgcatattattcagcagggcagcaaaaaagttccgatagtcagcaaactggaaaatgataccgctgcccgtcatgaactctttattgctgagtggcgcaagcaatgcagcgaaaagaaagcgcaggcgaagggctggcggcaatggctgacggaagaaatgcagtggtcagtgccagaaggtaacttctgggatgatgaaaaattacagcgtcgccttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcatcaggcgattgtgattctggagaaaggtcgctttatcagcccgtggaagcatattctggttgatgaatttcaggatatctcgccgcagcgggcagcgttgttagcggcattacgcaagcaaaacagtcagacgacgttgttcgctgttggtgatgactggcaggcgatttaccgattcagcggtgcgcaaatgtcgctcaccaccgctttccatgaaaactttggtgaaggcgaacgctgtgatttagacacgacttaccgttttaacagtcgtatcggtgaggtggcaaaccggtttattcagcagaacccaggccagctgaaaaagccgctaaacagcttaaccaatggagacaaaaaagccgtcacgttattggatgagagtcaacttgacgctttgctggataagctctctggttatgccaaaccggaagagcgcattctgatcctggcgcgttaccatcacatgaggcctgccagcctggaaaaagcggcaacacgctggccgaagttgcaaatcgactttatgaccattcatgccagcaaagggcaacaggcggattacgtcatcatcgttggcttgcaggagggaagtgatggttttccggctgcggcgcgggagtcgattatggaagaggcgctactgccaccggttgaggatttcccggacgctgaagaacggcggttaatgtacgtggcgctgacccgggcacgccatcgggtatgggcactgtttaacaaagagaatccctctccctttgtggaaatactgaaaaatctggatgtgccggtggcgagaaaaccgtaagaaacaggtggcgtttgccacctgtgcaatattacttcagacggtccgcgagataacgctgataatcggggatcagaatatcgaccgcgtcgttgaaatgcggcgactggattatgaagtctgccgttgccacgttggtggcgaccggaatgttccataccgtcgccagacgcagcaaggctttcacgtcaggatcgtgcggcacggcatttagtggatcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgcaggtaaagtgcgagtcgtcagttccataatgtacatccgtagttaactttcctacagattactgtaagcacttatcgctgcaagataaagaccgaaaaagcctgcgcacaggcacaaaaatctcaggaagatggttgtttttccgcccactgcaggaaagtatttcgcgtttgtgggtcagccagtttaaaccaatacttcagccgttgttctgtgagcacctgagactgcggtggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgccgttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactgaccaccagcggtggggagatatacagccgttcttcactattggaaagatgaatcgtcttctcaacgcgaaacactaactgatgcggtccattatccagttcaatgctgtccgcaccgcgcagcagagagctggaaaccttcttgccgtcgagtaccagaagatcgacatcggttgaaagccgcagcgtggtggcaaaaacggataccggcaaacataatgcaatcaaggtggtcacgatgccggttttcataggtagctcctgtcaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattccggtttcgccaaaagttgccggcaaaacgctgctgggccagaaggggtatggcacgctggcagacgttccggaaaaagtcgatatggtcgatgttttccgtaattcagaagcggcgtggggcgtggcacaggaagctattgccattggcgcgaaaactctctggatgcaactgggggtgattaatgagcaagcggcagtactggcacgggatgccgggttaaatgtggtgatggatcgctgcccggctattgagatccctcgcctgggcctggccaaataaaaaatccccggaaggcaaaaaccttccggggatttgttcagggattagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcgtcctccatcactacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccggataggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcagctgaatcgccagcatgttgatgtctttataaccacgacacgcgcccatcaactggcttttattctcaacaaacttcggcgggtccatcacgataacgtcaaatttttcaccgcgatcgcgataagtacgcagcaatttaaagacatcatcacggacaaactcagccttgctcagatccagtttgttcagctcaacgttctgccgtgcaatatccagcgcttcctgggaggtatcaacgctgacaacctggctgcaaccgcccatcagtgccgatacggcgaaaccaccggtataggagaaacagttcagcacacgtttattttcaacgtagcggcgggtagccaggcggctatcacgctggtccaggtagtagcccgttttgtgtccgtgctgaatatccaccagcagtttcattccgtgttcttcaatcggcagcagggcaggtggcaactcgccggtgacggggccctgggtcagctccattccttcttttttacgtaccgcgacgtcgctgcgatcgtaaatcgaacattccgggtacagcgtttgcagggcactaattaatgccgcgcgctgatattctgccccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgttgcaaacggcgggaaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaaatacattttaccggttttggcaggccagcaattttggtggcttgcttagccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttccggtgacagcgaaatcccttcgttctctgcaatcaccacagccagcggctcactccactggctgctttctttgagatagccttcggtatccgtttctatctctttaccttcgaagatcagcataattattactaccttaatcagactggcggcagtgtaacaaaaaacaaagccccgcataaagcgaggctatgaaagtgttagcgggtgagattaatcgcggctagcgaagcccagaatgctcagcaggctgacgaagatgttgtacagcgaaacatacaggctaaccgtggcacgaatatagttcgtctcaccgccatgaatgatgttgctggtttcaaacaagatagcgccagaggagatcagaatgaagaccgcgctgatcgccagatgcagagcaggcagctgcaggaagatattcgcaaccataccaatcagcaccaccacaatacccgccatcagcataccgccgaggaacgacatatctttgcgggtggtcagcacatatgcagagcagcagaagaacactaacgccgttccgcccagtgccatagcgattacgtcacccattccggcagacagataggtgttcagaataggtccgaggatataacccagaaaaccggtaaaggcgaatgcggagataatcccggtcggcttattcgccgttttataggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagtgatgtacggtcatgtgaagaactaacaatacgatccattgagtcactctctatgacagatgtaattaattaagcagcataatgataatgcgtaagggcacccagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgatagcgtgaaataacagcagattgatcatttcatcaccatgaattccttctcttttactcgtttagcaaccggctaaacatccccaccgcccggccaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccataagcgcccggtgtcctgccggtgtcgcaaggaggagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaacaaaccgcgcattccggtggtatggatccacggtctggaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcacgcaatacaatggcaaatatatcctcgcagtagaaggtaatccgccgctgggcgagcaggggatgttctgtatcagcagcggtcgaccgtttattgagaaactcaaacgtgccgctgccggagccagcgcgattatcgcctggggaacctgcgcgtcctggggctgcgtgcaggccgcgcgacccaatccgacgcaggcaacgcctatcgacaaagtcatcaccgacaaacccattatcaaagtacctggctgcccgccgatcccggatgtgatgagcgccatcattacttacatggtgacctttgatcgcttgccagatgtcgacagaatgggccgtccgctgatgttctatggtcagcgaatccacgataaatgctatcgccgcgcccacttcgacgccggagagttcgtccagagttgggatgatgacgctgcccgcaaaggttactgcctgtacaaaatgggctgcaaagggcctaccacctataacgcctgttcctccacacgctggaatgatggcgtttctttcccaatccagtctggtcacggctgcctgggctgtgcggaaaatggtttctgggatcgcggttcgttctacagccgcgtggtcgatattccgcaaatgggtactcattccaccgccgataccgtcggtttaaccgcgcttggcgtggtggcagcggctgttggtgtgcacgcagtcgccagcgccgttgaccagcgcagacgtcataaccagcaacctacagaaaccgaacatcagccaggcaatgaggataaacaggcatgagcactcagtacgaaactcagggatacaccatcaataatgccggacgccgcctggtggtcgacccgattacgcgcatcgaaggccacatgcgctgcgaagtgaatattaacgatcagaatgtgatcaccaatgccgtctcctgcggcaccatgtttcgcgggctggagatcatcctacaagggcgcgacccgcgcgatgcgtgggcgttcgttgaacgtatctgcggcgtctgtactggcgtacacgccctggcttcggtttacgccatcgaagatgctatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagtctctcctcttggccgaaatcatcccctggctatttcttcgacgtacaaaaccgcctgaaaaaatttgttgaaggcgggcagttggggatcttccgcaatggctactgggggcacccgcagtacaaactgccgccagaagctaacctgatgggctttgcccactatctcgaagctctcgatttccagcgtgaaattgtcaaaatccacgcggtctttggcggtaaaaacccgcatccaaactggattgtcggcgggatgccttgcgccatcaacattgacgaaagcggcgcggtcggggcagtcaatatggaacgcctgaacctggtgcagtcaattatcacccgcacggcggacttcattaacaacgtgatgatccccgacgccttagccatcggtcagttcaacaaaccgtggagcgaaatcggcactggtctttctgataaatgcgttctcagctacggcgcattcccggatattgccaacgactttggcgagaaaagtctgctgatgcctggcggcgcggtgattaacggcgacttcaacaatgtgctgccagtggatttggttgatccgcagcaggtgcaggagtttgtcgaccacgcctggtatcgatatcccaacgatcaggtcgggcgtcatccgttcgatggcatcaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcgcgcacgttaatcgcttatcacaaaggcgatgctgcgaccgttgagtcggtcgatcgcatgatgtcggcgttgaacctgccgctttccggtatccagtcaacgttaggccgcattttgtgccgcgcgcacgaagcgcagtgggccgcaggtaagttgcagtatttcttcgacaagctgatgaccaacctgaaaaacggcaatctcgccactgcttccacggaaaaatgggaacctgcaacctggccgacagagtgccgtggtgtcggttttaccgaagcgccgcgcggggcgttaggccactgggccgccattcgcgatggcaagattgatctctaccagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagctgatctccgtgcaggtgcgttaacagcgaaggagaatcatcatgcaacagaaaagcgacaacgttgtcagccactatgtctttgaagcgccagtgcgcatctggcactggttgacggtgttatgcatggcggtgttgatggtcaccggatactttatcggcaagccgctaccttccgtcagcggcgaggcgacgtatctgttctatatgggctacatcaggttaattcacttcagcgccgggatggtttttaccgtggttttgctgatgcggatctactgggcttttgttggcaatcgatactcccgcgagctgtttatcgtgccggtatggcgtaaaagctggtggcagggcgtgtggtatgaaatccgctggtatctgtttctggcaaaacgtccgagtgccgatataggccataatcccatcgcccaggcggcgatgttcggctatttcctgatgtcggtctttatgatcatcactggttttgcgctgtacagcgaacacagccagtacgctatttttgcgccgttccgttatgtggtggaatttttctactggacgggtggcaactcaatggacattcacagctggcatcggctggggatgtggctgattggcgcgtttgtgatcggtcatgtctacatggcgctgcgtgaagacatcatgtccgacgacacggtgatctccaccatggtcaacggctaccgtagccacaaatttggcaaaataagtaacaaggagcgttcatgagcgagcaacgcgtggtggtcatggggctgggcaacctgctgtgggccgatgaaggcttcggcgtgcgggtggcggaacggctgtatgcccattaccactggcccgagtatgtggagattgtcgatggcggtactcagggactgaacttgctggggtatgtcgaaagcgccagccatctgttgattctcgatgccattgactacgggctggaacctggaacgctgcgaacctatgccggagaacgcattccggcttatctcagcgcgaagaaaatgagcctgcatcagaacagtttctccgaagtgttggcgctggcggatatccgcggacatctgccagcacatattgccctcgtcggtctgcaacccgcaatgctcgacgactacggcggtagcctgagcgaactggcacgggagcaactgcccgctgcggaacaggcggcgctggcgcagcttgctgcgtggggaattgtgccgcaaccggctaatgaatcgcgctgtctcaattatgactgtctgtcgatggaaaattacgaaggcgttcgcttgcgccagtaccggatgacacaggaggagcagggatgagcaacgacacgccatttgatgcgttgtggcaacgaatgctggcgcgcggctggacgccagtcagtgaatcccgtcttgacgactggcttacgcaagcgccagacggcgtggtgttattaagcagtgacccgaaacgcacgccagaggtcagcgataatccggtaatgattggcgaattactgcgcgagtttcccgactatacatggcaggtggcgattgctgaccttgagcagagcgaagccatcggcgatcgctttggcgtctttcgctttcctgccactttagtgtttaccggcggaaactatcgcggcgtgctgaatggtattcacccgtgggcggaactgataaacctgatgcgcgggcttgtcgaaccgcagcaggagcgtgcctcatgagcgaaacttttttccatctgctggggccaggaacgcaaccgaacgatgacagtttcagcatgaatccactgccgatcacctgtcaggtgaatgatgaaccgagtatggcggccctggagcaatgtgctcacagcccgcaggtgattgcgctgttaaacgagttacaacatcaactaagcgaacgccaaccgccgttgggcgaggtgctggcagtcgatctgttaaatctcaacgccgacgatcgtcactttatcaatacgcttctcggggaaggggaagtgtcagtgcgcattcagcaggctgacgacagtgaaagtgaaatacaggaggcgatcttctgcggattatggcgggtgcgcagacgtcgcggcgaaaagttgctggaggacaaactggaggctggctgcgcgccgctggcgttgtggcaggcggcaacgcaaaatctcttgccgacagattcgctgttaccgccgcccattgatggcctgatgaatggcctaccgttggcgcatgagttactggcacatgtacgtaaccccgacgcgcagccgcacagcattaatctgacgcaattacccatcagcgaggctgatcggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgtcagtggctggcggaagctgcaccgacgtaaaaagacggtaagtatcgctttcagtcttatgaatatcgcaatcggcgaatacctctggtcgtagagtttcaggataaagagggagatctaccattatcgggttatttttctctcttcgcctacaggagtgcgcatgtgggatgtcattgatttatcgcgctggcagtttgctctgaccgcgctgtatcactttttatttgtaccccttaccctggggctgatttttttgctggctattatggaaaccatttacgtggtcaccggcaaaacaatctaccgcgatatgacgcgcttctggggtaagctcttcggtatcaattttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcaacggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagcttcagcgagctggtctttaatccggtcagccaggtgaaatttgtgcacaccgtaatggcgggctacgtgaccggggccatgtttattatggcgatcagcgcctggtatttactgcgcggacgggagcgcaatgtcgcattacgctcgtttgccatcggttccgtcttcggtactctggcgattatcggtaccctgcaactcggagacagttctgcgtatgaagtcgcgcaagtacaaccggtaaaactggcggcgatggaaggggagtggcaaacggaacctgcacctgcaccgttccatgtggttgcctggccggaacaggatcaagagcgtaacgcctttgccctcaaaattcccgcgctgctagggatcctcgccactcactcattagataaacccgtgccgggtctgaagaatttgatggctgaaacctacccacgcttgcaacgcggacgtatggcctggctgttaatgcaggaaatatcgcaaggcaatcgtgagccgcatgtgttgcaggcattccggggactggaaggtgacctgggctacggcatgttgctctcccgctatgcgccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgtccagacgctgcgtggcaaaatcgaccagcatcgctgggtgctgaaaatggcgctctggagtttgccgttgccgtggattgcgattgaagccgggtggtttatgaccgagtttggtcgtcagccgtgggcgatacaggacatcttaccgacatactccgcgcactccgctttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgccggatagtgataaacagcgttggtgcacactgggaaggcaaccaggtctggttgatcctcgctggtggggcattatttgccgcctggcccagagtgtatgcagcggcgttttccggcttttatgtggcgatgatcctggtgctgtgctcactgttcttccgcccgctggcctttgattatcgcggaaaaatcgccgatgcacgctggcgtaaaatgtgggacgccggtctggtcatcggcagtctggtgccgccggtagtcttcggtatcgccttcggcaacttgttgctcggcgtgccgtttgccttcacaccgcaattacgcgtggagtatctcggcagcttctggcaactgctgacgccattccctttattgtgcggattgctcagccttgggatggtgattttgcaaggtggcgtctggttacaactgaaaactgttggtgtgattcatctgcgttcacagctggcgaccaaacgcgctgcactgttggtgatgctgtgctttttgctggcgggttactggctgtgggtcggtattgatggctttgtactgctcgcccaggatgctaacggtccttccaatccgttaatgaaactggtggcagtgctacctggtgcctggatgaataattttgtcgagtcgcccgttttgtggatcttcccgctgctgggattcttctgcccattgctgacggtgatggcgatttatcgtggtcgcccgggttggggatttttgatggcatcattgatgcaatttggcgtgattttcacggcaggcatcacgctgttcccctttgtcatgccgtcaagcgtgagtccgatctccagcctgacgttgtgggacagtacttccagtcagctgacgctgagcattatgttggtaatcgtgctgatatttttgcccattgtgttgctctacactctctggagctactacaaaatgtgggggcgcatgacaacagaaactctccgccgtaacgaaaacgagttgtactaaggagcagaaacaatgtggtatttactttggttcgtcggcattttgttgatgtgttcgctctccacccttgtgttggtatggctggacccgcgtctgaaaagttaacgaacgtaggcctgatgcggcgcattagcatcgcatcaggcaatcaataatgtcagatatgaaaagcggaaacatatcgatgaaagcgatcttaatcccatttttatctcttctgattccgttaaccccgcaatctgcattcgctcagagtgagccggagctgaagctggaaagtgtggtgattgtcagtcgtcatggtgtgcgtgctccaaccaaggccacgcaactgatgcaggatgtcaccccagacgcatggccaacctggccggtaaaactgggttggctgacaccgcgcggtggtgagctaatcgcctatctcggacattaccaacgccagcgtctggtagccgacggattgctggcgaaaaagggctgcccgcagtctggtcaggtcgcgattattgctgatgtcgacgagcgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaacgtgactgacgcgatcctcagcagggcaggagggtcaattgctgactttaccgggcatcggcaaacggcgtttcgcgaactggaacgggtgcttaattttccgcaatcaaacttgtgccttaaacgtgagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtttgcataacgcgcaattttatttgctacaacgcacgccagaggttgcccgcagccgcgccaccccgttattagatttgatcaagacagcgttgacgccccatccaccgcaaaaacaggcgtatggtgtgacattacccacttcagtgctgtttatcgccggacacgatactaatctggcaaatctcggcggcgcactggagctcaactggacgcttcccggtcagccggataacacgccgccaggtggtgaactggtgtttgaacgctggcgtcggctaagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcagggcatgtgttcgttggcaggttttacgcaaatcgtgaatgaagcacgcataccggcgtgcagtttgtaatgcataaaaaagagcattcagttacctgaatgctctgaggctgatgacaaacgaagaactgtctaatgcgtagaccggaaaaggcgttcacgccgcatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcattagaatgttattctccgtctccatcatagcgaaatgcagactggttcgtagcgcacgtacggcttccacagcagaatccgccgggttatccaccgccaggaaggggatatttttagtacgatggcgctgctgattagaaaataaatttttcttacgcagacgggtgcgtttatccagccactcggacattgggatagtggcataaacgctgatgccgtgctcttccagttgttccggggcttctacaccacgacgcaacatcgcacgcgccagcacggcacccacagaaataaacaggccaagaataaaaccaagcaccacgttcaacgcttttttcggtttcactggctgcggctgagtgactgccgggtcgataatccgcacgttaccaatggcactggatttcgaaatactcaactcctgctggcggttaagtaattgcagatataccgcacggcccgcttctacgtcacgacttaaacgcaacacttcctgttgggtggaaggcattgccgatacccgcttattcaggcgtttgcgttcttgctccagcgtctggcgtttttccagcagcgcacgataagttgggtgatctttcttatacagctgggagatctctgcctcgcggaaggtcagctcattgagttgattatcaacgttcacaatctgctcaagaacggctttggcttccaggttaaggtcaaccgaatcgcgctgctggcgataaacgttgagtttttcttccgcttggtccagctcgctgcgcacttcaggtaactggcgctgtaagaattcaaggctttgtgaatcctgcgccgcctggcgagcgatattctgttgcaaatagttgttagcgatgctgttcagaatacgagtaatcaactggggatcatcaccagtcatggtaagttccagcatcccgctttctttactgcgttcgctaacggtaaaggtttcctgcaatgcgttaatcgcttccagttcggtacgctggctcaggacaaactgtgttcctggtttggccttaatgtccgcgatagtcagcgcaacgccatctttttccagacgctggccgaccataccattgacggtgaactcttcaccttccagtgtatagtggccgttttccccaaccgtgagtgtcagttgctgatcctgaccattcagttgtggaatatgcatccagctgatcgccagctcacctggtttttctttggttaatctcgcccagccgcgacccacaatcggaaaatacttctgctcaactatgtcgcgcagattcagttcagcaatggttttaccgagaatcatgcgcgattgcagcagttggatctccggtgcagactcgggcgatgagttagggatcatatcgctcaggccgctgagaatggcgttgccctgtttttgctcaacctggaccagagtatctgcctgataaattggtgtgcttaacagcgagtaagcgacagcgatcagcgtgaataacgcggtcacgctgataataaacttacggtgatcccataactcgccgaccagacgaagcagatcgatctcattttcctgagtgctgcctggtggcgtattcatatttttagttgtcatcgtattttataaactcaaattaccggctgaggcgcttcgcccattcctgactggcgcgctccaacataccgtagacatgttcaaatgcgtcctgacttttacgatagggatccgggatctctttctgttccagccattgcccaaacagcattgtcttcccgcggacctcgggagcaattgcggtaacctgagcaatatgttccgactccattgccagaatcagatcgtaatttcgtgccatctcagcagtgagcttacgtccggcatgtccttcaagagatacgccatgattagcggcaacatctgccgctgtcgcatctgcagggtgttttaccagaccatgaacacctgccgatttgacttttacgcccggcagacgtttacgcagcaagcgctcgccaatgggcgaacggcaaatgttgccggtacaaaccaccaggattgagttaaattttagttgggccatgtttgaatccaccgtgaagtctctgtcaggtcatgcaccccggaaatcgtcggtaccagcagagaaatcacacggttccaacgagccagcggcgcggtagtgacataaacaatgtcgtaaggttcaagctggaattccgttccgagtatcattgccgatgcgtccttcgcattcagctgataaatattggcgattttgccattctgcttgttttgcgttgcacgaataacaaaaatccccgtcgcatcagcgacatcctgattcataccctcagcgttacccagcgcttccgccagggtcataccgctgcggtccattttcagcgtgctctgtttacccacttcacccatcacgaagactttcagatcatcgttgcgcggaataaataaaatatcgcccgggtgcagcagtttgttctggcgcaagtcgccacgctgcatcagcgcatagaggttcactttggtctttacgccattctgggtgagcaccacgttgcgccagtctgcatctgcggtcagaccgcccgcggcgttaatcgcatccatgatggtcagaggaatattggtaatcggctgctgacccgatttgctgacttcgccggtgacgtacgctttttgcgatcggaacgccgcgacgctgacatcgacttgcgggctttcaatgactgaatcgagacgcgctgtaatctcgttgcgtacctgggtaagtgttttcccggccactttcaggcgaccaatataggggtagaaaatcgcaccatcggcgttaacccagttgccggtatcactggcgctacggtattgccctgcgggggtggttagttccgggtgatcccagaccgtaaccatcaacacatcaccaatcccgatacgatattcatagtttgcgatttgctgctccagctccgggttagcctgcgacataatcggtttggcgcgcaactgatcaatcaatcctggcgtgacgggatagatattgaccattttgtccaggtcatactgattgtcaggtagttcaatgacatccttgttactggtcgataaattctgaccaggaacaagggtacatgctgtcaaagacagaacagccaatgtcagtaccgaaaacttaaaaatgttctttttcattggtttatatttatcagtcaatgtaatgttatgaattacgtcaggttattgtccaaccggtacttctcgctctgccgtcattggatagagctggtatttgcgtgacagcatttgtccaccatcacgcgtcaatggtgtccacgaaaccaccgcgcggttgcggttaggtccaatggtcatcaagtcgaatggaatcgagatataaaaacctttactaaagccgccttcgccgtagtcatctttagatacgttactgattgccgcccatacccctaccgccacgccgctgtcaaagcgtttggcgacgtcgatcgttgcgcctttatcttttgccagatattgcccaacgctaagtttcatcagtacgccattgagcgtcggcgggttccagtaagccgtcacgaaacctgttggcgtggaataatcggtgaaacgcatcatgttgtcccagtcacgttgcttcacgtagttaacgtccacacccagcgcccagcaggcatctagcgggcgataaagcagctcggaaccgacaccggcgtacatcgtttccagataaccgccatacacctggccatagaaaccattgcctaagtcagcaaaatagttcgcctgcaagttgttgagataaacgtcattgcgaacgtagtcacggatatgcgtgcgcacgcggggcagggtagagtccgcgggcaacagcgaagacttaaacttgtcgtagttgttgtaaatattggtgaaaataccgccatcaagcagcaggtggtcggtaaaccagtagcgggcactggacatcagccccagctggaacatatagaaatcttccgggccgcccagcgactgtgaaagtgttgggttgaaagagtagctaaagcgatcttcacgaatacggtagccccgaccaaaggcagaaagatcttcagcttcaacacgttgttgttgcagtggctctgattgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacgagagtcacggtatttgtattgctgaccagacatatacagtgtcttatcgcgtagctgaatttctggcgcgtcaaagcccgcgttatacttcagggcggtaagttggtttgctaccgtggtgtactgcaatccttcagattcaggcgcaggttgatatgccggttttggcgtatcgcgcagggcagggcgcagatcgttgaaattggtccgtaacgtgaagccaaacatcaacgtgttaccgcgttcataactcaggttgagatctgcccagctggcagcgcgataaactgcgccgacgttgaaatggcttgcctgaggcagtttgccagcgaaatcattctggtaattgtttccatcgtattcgagtttcagacgcaggggattccacggcgtttgatactcaatgccgccaaagatggaagccgggccacgaaagatatcgctaaagctgatatcgcccgcatcgtgagactctgcgcgatgacaatatttatcgctcacccggcaaaacgggttggtaatattgcccgcattaccggcgtagccccatgccatcccgagggtgaaatcaaatggccccgcttgcttgctggccaccagatactcaccgtcaaacagacccgtaccagcaatatcacgtttaccaaacgccacttgcggtagccagtaaccttcttcccacaggcgaagtttaaaatcgaatgatttgtctttgtatgactgatcgccgctgaaatcttcccactggctatatttgcgtgtgcgcacatccgtataacgaatggtgccttccagccatgggaacagcgccacggaggtggagtagaaccggtattgatcgttatcccggtagttgacgctgaattcaccttccggtgcgatgcgcgcatttggcatctgcaacaatcctgtgccgccaaagtctgattgcgacgaacccagcggatccgggtaggttaatacttcagcatgacaggcactggagacggcaatggccaggcagcttaaaagataagaattcttcttcatcagtcaggaacacgttgcgttaaaacagacacaatctggtcatttaaatcagcatatttttcgggcagtacatgcgcagaaaagcccaaccaaagctggctgccaggcggtggttccacatgtcttttattccacagggcaacaggggcgacgacagtctcaccctcaggcgtaatcaccataacgttattcttgtccgcgcctgcaaggcgggggtgatcttgcagataatcggtaacgctacggcctgcctgccagggcaattgcccggccccagaaaccgcacccagcagagtaatagtcaccggacgctgtacggtatagagcgtatagtccccgaccaacgggggattgctgttctcatccactcgtacaaaatcagggtccagtttgaccggtaagcgaccagtgatattgagattgagtaactgctggcgcacggatttaatcgttgccgccacatcgtcgtcagcttctgcttcccaggaagcaagctgtgccatgacatgttggtagtctttaagcgctttagctttcgccgcagagtcggtcagcaaggcaccaggccaccagaggcgatcgcgcagttgcggttgtgtcaccaactggacaacattttccacggggccaacggaaagtgtctgttgttcgccaggcagataaatagtcaccgttccttgcgcaaaggcatggggtgtcattacgtaaagtacgctggcaatgaaatacgactgtaatttattcatggtgcgggtttaagaaacgtcatttctacgggaataacccctgcgcctaacatttgccgactttgacgaacctggccagtagccgaatcgacccagaatgtgttttgccactgtttttctggccgcgtggaagtcacctcttcctgccagacattacacagcacattgcgacccgcaatattcagcgtctctaatccagcaaaggaaaaagtagaactcagggtcgcagagcgaaaatggttgtcttcactccagagaatatcgcgcgtccagcggctgccatcttttattgccagcgcgttacgcagagggtcctgcccggaatttgtcacttccagcagattattattaagtttgacggtttttaaaagacgtccattgtgggtaaccagcatggcgttatcctgggataaccatttgctttgttcttgttctatatatcccagtaccacaaagattcgttgcccttcattaaggcgtaaatacatagtggaataaggcaacgcctggatctgctgatccgctacggtgatatcctgattatcgaaaaggctggcgcgaaatgtatcgaccatactttgctggctgtgcgtacatcccgcaagaaatagtgcgaaaatcgataaaataagagggcgcacctttaatccttgaaaggttaattaaaaaaatgcaaatctctaaagcccggtacgaatatcgcaaccgggtatcatttaactttaatttcgacgcgttaaagcagtattagcgtgtagtggacgtggtggttgaggtgttatgagaaccgccatcgccactgtcatttgctgcaacaactgccaacgtcgccacaccaacagccgttgccacaccgacaactgtcgccgtgccgacagcgccagcagccacgccaccagtggtagtagcagtcgtggttgcgccggtagtggtcgttgtggtgccagtagtacccgtcgttgcctcggtcccgtttgttgcttcaggggcagcaaacgcagctggcgtcgtcaacatgaaggccataaggattgcagaaagcttgtgtttcataacttttcctttattcatcgcatggacaatacgggtgatgctgccaacttactgatttagtgtatgatggtgtttttgaggttctccagtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggtataacctgaatctgaggcagcacctggcacggctgggacggaagtcgctgtcgttctcaaaatcggtggagctgcatgacaaagtcatcgggcattatctgaacataaaacactatcaataagttggagtcattaccgacaatacgtacgcttgagatcaggattgtctactttgagtataacatccttgtgaaatctccctttcctcataccgcttgcactatatactgcgggtaggaaaggcgcgcagagggaaatataagattgttaactatccccctctggaaatacgacttgtgagcataagataaatcttagcaaaatacaaattaaagataaggaaattgttacgaaagctattaattattgttggtaatatagtttcaagtggtactataactggctgttaaatggcatttataactattaggtgcagagatattcgcttaaatggattagtttctttgtggaaaagtaactgatgttataatgtatgatgttgactatttcactattccaataaaaccagtcagctttaaacaagcagcgtcatattaagagagataaacatttgccgctgttggtcctcgcaggccatttacgcggcaaaattccacacgtaatcctggtataagcacttctgcgtcgcggggagtgaatgcggaaatatggacctgaacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcaccgccatccagagcaatgaattccgcacgctgaacgaaaatcagaaagttgaattttctattgagcaggggcaacgtggccccgcggcagcgaacgttgttacgctctaaggttgccattattactcaacatctccatttccgctgtccatgttgtcatggttcacagtaccgcacatcggcattcgatgtgacggagcgaaaccctttgggcgctaagtgtattttttgtaaatcgacgatgatcacctttgataacgtcgcgctgcaaatacgcactgaccatgcgccgctggatttcacaaaataatatcaggctccctcgtggagccttttttatatctgccttatttttcttcaacgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgcttgtggaattaagcgtcggtacaattcctccggcaccgggctttgccatactcccgcatacattgcgtaaccaatcaccgcaaacataatccccagaaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgaattaatttatcgaccgggatccgtgatgggcaattttttgcgcatttgccacagtcgatacaactttcggcattgcgacgaatcttaaacggcgacaatagcgaaaccacgcccatcagcgcgccatatgggcaaagataacgacaccaggcatggcgaataaacaggctggcaatcagcaaaacggtcacgctgattaatgtcgcggtccccatatgacgaaagaaatcgagcattttaacgtccatcaccacgctgtagggcgacaacataaaatagtgaatcgcctgagcgggcatcaataacgcgatatagataaaaaaactcaacagcaaatacttcacgccgcgcagaggaatatccagccagcggggaaggacacattgccgaccaaacagtttgttaccgagatcgccgattaattcagaaagcgtaccaaccgggcataaccatgagcaaaaggcctttttgagtaatagactgatgacgataaaagcgaccaataacagcatcgcggcggcgtggacggacggtaactgacctgttacaaggctatatttcagattcatcagcccggcaatcggtagccagccttcgatacctcccggtctggcgacaaatgtcgtgctacttgccgtttcgtaatagcgcacccaataccagaacgtgatggcaatataaatattcattgccaacagtaataattgcgtcgctttacgccaggtcgtggcattacgccagtcattccacggtaatttgccgcccgtcgtgcctggccgccgctgccagcgggttcttttattctctgccatgattttgccagtccgttaagttgtataccaaatgccactattctagttgttcttaactggctgatattgattcaaatcgcgttcaggtctttcttatgcaaccatgcttccagagcggcaacactgcgtgtaatttcttcgtgtggaaggggggcagataatggctgctgctccagttgtgcgcatagctggctggcgatatgcattcccagactcgagcaactgctttttagctgatgcgcggcacgctttattttctcgctatcctgactggcgcgggcaatgtcgatttcatcgagaagcggcagggcatgttgtgtaaataataccagccattcgtggatcttctccgtccccattaactgagcatcttcattgagttgcgatacatccagcgattgatcattattgacttgcagttggagatagtgcgccagtaactgaccgagcacttcacgcggcaccggtttagggataatcccgcggaataatgaactggtacgctggcgcagcgtttcgtcaatgacatgggcgctaaagccaatcaaaaccagcgacggatattgctgtgccagttgtcgggcaagcgtaatgccgtcgatatccggcagatcaaaatccaccagtgcggcagcaaacggttcgctattttgcagtgtctctaaagcctgcgcggcattgccaacagcaacaatctgcgcaccactggttttcagcatctcaatggtaattcgctgggttagcgggttatcttcaattaacagcaaacgtaaaccgtcaagacgcaccgcctgattgactgtttttggcacgggtgccgtggcaacacgtaacggcaagcgtaaacaaaaacagcttccaacctccggcgtgctggtggcgctcagttcgccgcccatcgcctgggccagacggctactgatagtcagtcccagcccggtgccgccgcgtttgccgcttacctgcacaaatggctggaagatttctgccagtttcgcgggatcaataccgcagccgctgtcttccacttcgaccagccattgctcgccatcagtgcgactacgcaggataatgtacccttcgtcagtaaaacgcagggcgttgctcaacaggttggttataacctgacgaatacgtcgtggatcgcccattaacgcgcacggcatatcatcggcaattgccgttgccaggcgaatcgggcgacctttcacccgtccgctcattaattgcagggtactttccagcagcgggcgcggttcaaagggctcatcgctgaccgaaacattcttgccacctgcttcgatagcggaataatcgagaatatcgttgaggatggtcagcaacgattcaccagagtcagtaattgcccgcaaatcatcacgctgggcgttaagtgcggggttatctgccagcagttgagcagtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacattgctgcgaaacgcatccatcagccgcccgatggtatccagctcccgtacgccagcggtttccgggaaaggggagtcaatatcaccgtccagcagccgttgcagcgcctgcgtttgttcggcaagtggacgcgtgactgagcgataaaccacgcgccagaggatcagaatcagtgcgcaaagtgaaaccatccccagcaataacaggctgtattgcccgcgtgcactcgctttttccagatgcgccagtccgtgctgattacgcagctcaatggtgtcgaccagctgactgacttcgctactaaactgcgcgaactgggcgatgttattttgtgcgagagtttgtaggtgattgctgatttcactgtcctgctgatacagcgccagcaaatcgctatattggctaacggtagttaacgttgttgcgacctgcgcacgaacacccggatcttcaatgcgtatttgccgacgttgcagaattttcaccgcattattgagctgcttttccagcgttggtgcatttttctggatctgctccagccccagattcatcaccatttgctgcacccgcagagcgctaaggcgcagttcattcatctggttaacatactcaagatcgatatcaatcagccgatcgagtgcactttcagcagcctgacgctgatcttgttcgatcaaatcgtaaatcccggcctgggtcgctccagcggaagttgtcgcattattcgcctgaccttgcgccaggcgtgcgatctcatcggcggcagcgactatctgctgactgagttgctgttgttgctggcgcagttgcaaacgctgccccaccagttccccttgctgacgtaacgaacgggagatctcctgctcctgttgttcaatagcggtggtatcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcggaatgcatctagcataaagccttattattgatgaggctatcatgcgcgtactgctatttttacttctttcccttttcatgttgccggcattttcggctgataacctgttgcgctggcatgatgcgcagcatttcacggtgcaagcctctacgccgcttaaagccaaacgcgcatggaaactgtgcgcgctttatcccagcctgaaagattcatattggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacctcatttcccgacctgcaaaagcaggtagcaagtctgccggtgatcgaactggtaaatgctattgatgctccccaggtgaaaagccgcgttggtgtgccctggtttcagatgggctatcaaccggggcgatatctggtgcaatgggcgcacggtaaaccactgaatgtgctgttgatgcccggacccgataacgccgggggcagtaaggagatggtcgagggttttcgcgcagccattgccggaagcccggtgcgtattgttgatattgcgcttggtgataacgatattgaaatccagcgtaacctgttgcaggagatgctggaacgccatccagaaatcgacgtcgttgccggaacggccattgcggcagaggcggcaatgggggaagggcgtaacctgaaaacgccgcttaccgtggtgtcgttttatctttcacatcaggtgtatcgcgggctgaagcggggaagagtgattatggctgccagcgatcaaatggtctggcagggggaactggcggttgagcaggccatcaggcaattacaggggcaatcggtttctgataatgtcagcccaccgattttagttctgacgccgaaaaatgccgaccgtgaacatattcgccgctcgctgtcaccagggggatttcgtccggtctatttttatcagcacacatcagcggctaagaaataaccttcaccatgttgcgtcaccagtaaatccgcgctgagtttatgacgtaaacgacgaattaacacatcgacggtgcgcaggtcagggttttccacccgacgcgcagaaagcatacgtagcagacgttcacggctgagaatttcgcccggattcgtcacaaatgccaccaacatttcatactctgcgcgggtcagtttaatcggctcgccatcccgctccagcgtatggcgcgacacattcaggcaataaccggcaaagcgatagcagttgtcctgagtgtgcggttgagcttgtcgcgcgaggtcgattcgccagagcagatttttcacccgtactaccagttcgcgcagttccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggtaagttgatatccagcagaattaaatctaccgactgattctgcataatttcccgtagcccagcaccgctcgccgtaacggaaacggtatacccctcctgagtgaagtaggattgtaatcgcgcctgggtaaccggctcatcttcaacaataacaatgtgatgtggcatcagagggttttactcattctgttcatatctgttcatattctgccgtaagccgttcatcctgaccagtgccgctgttcatatttgctcattaagatcgcttcactaaaccataattctacaggggttattatgcggaaactctggaacgcgctacgccgacccagtgctcgttggtcggtactggcgctggtcgcaattgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaatgatatctaccagacctttattgctcactccattgatacacctgaaaaattcgaagccaaacgcgcggaacttgccgagcgtgaatgggcgcgaatgaaagaaaacaactcggcaacctgccgctcctgccataactacgatgcgatggatcatgcgaagcagcatcctgaagcagcacgtcagatgaaggtggcagcgaaagataatcaatcctgcatcgactgtcataaaggtattgcccaccagttaccggatatgagtagcggcttccgtaagcagttcgatgagctgcgcgccagtgctaatgacagtggtgacacgctgtactctattgatattaagccaatttatgcggcgaaaggcgataaagaagcctctggttctctgctgcctgcttcggaagtgaaagtccttaaacgtgacggcgactggctgcaaattgaaattaccggctggacggaaagcgccggacgtcagcgtgtactcacccaattcccaggtaaacgcatctttgttgcctcgattcgtggtgatgtgcagcagcaggtaaaaacgctggagaaaaccaccgttgccgacaccaataccgagtggagcaagttgcaggccactgcgtggatgaagaaaggcgacatggtgaacgatatcaaaccgatctgggcttatgcggattcgttgtacaacggcacctgtaaccagtgccacggcgcaccggaaatcgcccactttgacgctaacggttggatcggcacgctcaacggcatgattggctttaccagtctcgataaacgtgaagaacgcaccttgttgaaatatctgcaaatgaatgcgtctgacaccgcaggtaaggctcacggcgataagaaggaagaaaaataatgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcgtagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaaaatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatgaccacgctgacagcacaacagattgcctgtgtttacgcctggctagcgcagttgttctcccgtgagctggacgatgaacaactgacgcaaatcgccagtgcgcagatggctgaatggttttcgttgctgaaaagcgaaccgccgctcactgcggcggtgaacgagctggaaaaccgtattgccacgctgacagtacgtgacgatgcccgtctggaactggccgcggacttttgcggcctgtttctgatgaccgacaaacaagcggcgctgccgtatgcatcggcctacaaacaggacgagcaagagattaaacgcttgttagttgaggcagggatggaaaccagcggcaatttcaacgaaccggcagatcatctggcgatctatctcgaattgctcagccatctgcatttttcgctgggagaggggaccgttcctgcgcgaagaatcgacagtttgcggcaaaaaacactgacggcgctgtggcaatggttaccagagtttgttgcgcgttgtcgtcagtatgacagctttggtttttacgcggcactaagccagttattgctggtgttagtggagtgcgaccaccaaaacagataacgtcgtttgtgcgcctgaaaagacgcgtttagcgtcgcatcaggcattatggcgcagttgccggatgcggcgtgaacgtcttatccggcccacaggaactgtaatctttgtagaccggttaagatgcgtcatcgcatccggcaaacacacatcacggatgagctacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtttcctggatctcacgcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgcctggcgggatagtcagcaaaatgctttctttcagtgttggaacggtgactttagcacccagcgccgcttcccacgggctaaccggcaccacaatttccagatcctggccgacaatatcaaacagcggatgtggcgcaatatgaatcaccagccacaaatcgccatttggaccgccgttttcgcccggcgtcccctggcctttcagacggatgcgttgaccattgccgacgcccgccgggatcttcacattcagcgttttcggaatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatggtggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggcaagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggagaggaggtcgccatcaagatgggttgctgaacatattttaaacaggtgaaaaagggtgagcgatttttgatagttgaaccaggcactttaagtttaactagggcgtcattatttattaaattttatagacgctatatatgggtagtaatatacatggaattagttgcactgcaaataattatttgaaacaggcctggaacgatataaaaaatgagtacgaaaaaaatcaaacatattcaatcacgctttttgaaaacacactggtgtgttttatgcggttatacaatgaactcagacgtaaagtaaatgaagaggatactccatgtctggaatgtgaatcactagaaaaagaatttgaggaaatgcagaatgataatgatctatcattatttatgagaatattgcgtactaatgatacacaaatttattcaggggtttcaggaggtattacatatactatacaatatgttcgagatattgatattgttagagtgtccttgccgggcagagcttcagagtctatcacagattttaaaggttattattggtataactttatggagtatattgaaaacattaatgcgtgtgatgatgttttttctgagtattgttttgatgatgaaaatataagtgtccagccagagcggataaatacgccgggaatatctgatttggattctgacattgatttgtctggtatatcttttattcagcgtgaaactaaccaggcattaggattaaaatatgctcctgtagatggcgatggatattgtctgttaagagctatactggttttaaaacaacatgattattcatgggcgctggtcagttataagatgcaaaaggaagtttacaacgaattcattaaaatggttgataaaaaaacgatcgaggctcttgttgatacggcattctataatctcagggaagatgtaaagacgttatttggcgttgatctacaatctgacaaccaaattcaggggcagagtagtcttatgtcatggagctttctgttttttaaaaaacaattcattgatagttgcttgaataacgaaaaatgtatcctgcatttacccgagtttatatttaatgataacaagaacttgcttgctttagataccgacacgtcggataggattaaagcggtgaagaattttcttgttgttctttcagatagcatttgctcattatttattgttaatagtaatgtggcatcaatctccttggggaatgaatccttttcaacagatgaagatcttgagtatggttatttaatgaacactggcaatcattatgacgtttacctccctcctgaactttttgctcaggcttacaagttaaacaataaggaaatgaatgcgcaactcgactatttaaatcgttatgcaatttaatggcaaaggcatatgctaaaaaccattgttattagtctcacacttttttattggtaaatattgtctctgtattggtaacgccgcagatattctgtttagccacaggtgcaattatcagcggcgtacgcgaggcaggggctaatcaggcatagtttgcgtcaaaccttgcctgtttttgaagatgtatatagaaaaacaggcgttcaacaagccattttgcgaacctgttcccggaaaaaagtcatatttctgtcacactctttagtgattgataacaaaagaggtgccaggaatgaacaaaacgctaatcgccgcagctgtggcagggatagttttactcgcttcaaacgctcaggcacaaaccgtaccggaaggctatcagctacagcaagtgctcatgatgagccgccataacttacgtgcgccgctggcgaacaatggcagtgtgctggagcagtcgacgccgaataaatggccagaatgggacgtccccggtgggcaactcaccaccaaaggtggcgtgctcgaagtgtatatgggccattacatgcgtgaatggctggcagagcaggggatggtgaaatcgggggaatgcccgccgccgtacaccgtttatgcctatgccaatagtctgcaacgtaccgttgcgaccgcacagttctttattaccggcgcattcccggggtgtgatattcctgtgcatcaccaggaaaaaatgggcactatggacccaacctttaacccggtgatcaccgatgattccgccgcattcagtgaacaggcggtggcggcaatggagaaagagctcagcaaactccagcttaccgacagctaccagctactggaaaaaatcgttaactataaagattcccctgcctgtaaagagaaacaacagtgttcgctggtggatggcaaaaatacctttagcgccaagtatcaacaagaaccaggtgtttccgggccgctgaaagtcggcaactcgctggtagatgcgtttactttgcaatattacgaaggttttccgatggatcaggtggcctggggagaaatcaaatctgaccagcagtggaaggtgttgtcgaagcttaaaaacggctaccaggacagcctgtttacctcaccggaagtggcgcgcaatgttgcgaaaccgctggtcagttatatcgacaaagctctggtcaccgatcgcaccagcgcaccgaaaattacagtgttggttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgatttgatgaaaattgaatatgtgtatcagagtgcggaacagttacgtaatgccgatgcgttaaccctgcaggcacctgcgcagcgtgtgacgctggaattaagcggttgcccgatagacgctgatggtttctgcccgatggataagtttgatagcgtgttgaatgaagcggtgaaataacagaaaactcccccgcgagaagcgggggagtcgctggttaaacgtttttacgttcgatggtctgttcgccccaaaaaagcgaatctttatcggtcttagcaaaggctttgactaacacttcatcactaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatagggacaattaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttgccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttcagcgccatccactttgcttgcaccctcagcgactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaagaatgacccgcagcgcgcatctgaagcaggtaaaaaaggtggtaagagcagtcacggcaaaagcgacaactagccgggctaatcaatgacgaatgcatttttgtctgtagctcgtcaaaaagccatcaccgccggttacccggtggttgatactgatgacaaatgtaagcttgcctgatgcgcgatgcttatcaggcctaccagaagattgcaatatattgaatttgcactgttttgtaggccggataaggcgtttacgccgcatccggcatgaacaatgcgtacgttgtcaacaatctgcaccgccggtaaccccggcggttttctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccatatccttgcgcctgcgacggcaatcagcccgaacacaacaattgatgcaccaccaataaccgcggccggaatggtatgaatcagcgcaccaaatttcggtgaaaagcccaacagcatggcgatgacggcagcagcaacaaacaccagcgtcgagtagactttggtcacggccatcacaccgatattttcagcataggtggtcacgccgctaccgccgacagagccggaaagcatcgttgccagaccatcgcctacgaatgcccgccccatatacgggtccatattgcgtccggtcatcccggcgactgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatacagcagacaggcgacaattaatcctacgagaatcaataaccgctggatcatgccacgggtaaacaccgccaccagcccaatacacagcaccgtcattaccgccatccagctatcaaaggccgaagccgatacacttttcactgcgataggcgctaagttcaggccaatcgccatcaccaccgcacccgtcaccaccggcggcatcagtcgttcaatccagcgcgtaccgattttcatcaccaccaggccaatgacggtataaaccagcccacaggcgataatcccgcccagcgcaatgctgatattcgggttaatgccctgaccgttaaagcccgtcgcggcgatcaccacgccgacaaaagccgcgctggagccgagataactggggacgcgcccgccggtaataaagaaaaacagtaacgtgccgatccccgacattaaaatggaaagattgggatccagccccatcagaatcggcattaacaccgtcgcgccaaacatcgccaccgcgtgttgaacgcccattactgccgtctgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggtgtgacgatgaatcgcttcgatggcgcaaaacagaatgtcgtgggtgccgacgctcaccacctggctgatacggcagtcaaacgaaaccagagcctcttccagttgcgggcatccggtcacccccgtctgccagcgggcggcggcaaagcggtgttccatgggcgttttgccgccaaaaaggtttgaaagcggctcctgcccggcgctaagtgtatttacacacagcgttcgattttcattgaatgccggccagacggacgccccacgattcaggcacaccagtaatgtgggcggcgtatcggtcacactgcagacggcgctggcggtgaacccggcgcgcccggctggaccgtccgtggtgataatattgaccgccgcgcccatgcaggacatcgcatcgcgaaaagtttgttgatcgacaatgttcatagtttgctccttacaacagcccgcaggcttcttcaaaggacagacgtggcaggcgcgcataaagcttgctgctatcgccatagccgatattaatcagcagattgctcttcagcgtgctgcccgtaaaaaaggcgtcgtccacgtgttgacggtcaaagcccgacatcgggccggtatccagtcccagcgcccggcaggcgacgatcagataggccgcctgcatggaactgttgcgaaacgctgtttcttcggcaagttgtgggctggaggtaaaccaactgcgggcatcaccgtggggaaacagtagtggtaaccgttcataaaattcactgtcccaggcgacgatagcggtgacgggcgcggtcagggttttttgcagattgccgctggaaagtgccgggcgcagacgttcttttccttctgccgtgcgggtaaacacgatccgtgccggagaacagttagctgatgtcggcccccatttcatcagggcataaatctcccgtaacgtctcatcgctgacgggtgtctcccgccagccgttgtgagtgcgggcatcggtgaacagggtgctaagcgcacctgggctaacggcttcgttcatagcaattccttacagggcggcttcacggtgatgtaacaggctggcaagcccgttgagtaacagagcattaaacgtttcgggatcggtcacgttgcaggcgtgtccgccatagggcatcaccattttctggctatcgggcagggcggcatgaagttcactggaacatgctgttggcaccagcagatcatcactggcgcagatgatttgcaccgggcagcggatgcgatccgcatggtgactaaagtcagcgcgtttgagggcgttaagtcgacgcagtaaattatttttgccctgaaaatgcgccagtgccagcgcgtcttctgcctccaggcgaggtgcgcgggccgccatccagtcggcgggatagaggaacaacggctgcgcttccacccatgcctgcgcgccgccgctatacagtaatcgttcgcgaacctgaaaacagcggcgcgtatgggcgtttattcgtagccagccgttaacgctgatcagcacagttaccgacgcgggataatccagcgccagctgcattcccaccagcgcaccgagcgcatggccgaccactgcgtaatgctcaatccctgcggctaccagcgcctgatgcagttccgctgccatctgggcgatactgtaatcttctgccagcgtgtcgggattattgccggtgccgcgctggtcgtaacagactacctgatactcctgctccagcaccgccagttgcggtaaccagtaactgccgctacccccaagacccgaaatcaacaccactacgggcgcatcagcataagggggaggtgagagtgaaagtttcatcgcggcctcacttggcgatatgcgcaattgtggcgatttccaccagcgcgtcaggttttaccagtccgcactgaatgcagaatcgcgccggtttatcacccggaaaaaactcggcgtagatttcgttaatcgcggcgtaatttttccagtcggtaataaagatgctgttgaaggtcacatccgccatcgtgccacccgccgtctcgatcaccttgcggatagtttccagaacgtggcgggtttgcgcctttgggtcatcggcaaacagcacgttattatgttgatcaaaagccagcgtaccggagacatacaccacgccatcagccagcgtgccgggaacgaagggggccagcggtgcgctgctgccagcgggaataattacggattttggcatcgttaaactccttaagcgatatgagcaaaggacgtgggagaaagcgcgtcgcagaatgtttcgacgtcgctgacccagccaaaaaaggtttcgatattgaacaacgcggctttctgcgcaaatttcggccccgcctggtgagttgcgtcttcaagcaccacgccgaaatactccagaaaaaagccgtcgcgtagcgtcgattcgacgcagacgttggtagcgatgccggtgaaaaccagatggcgtattccgcggctgcgcaaaatgctgtccagcggcgtattgaagaaaccgctgtagcgcggcttcggcagcacaatatcgccaggctgcggcaccagttcatccaccagttgataatcccaggagcctttcgccagcaatttcccctgcagctgcggctgcttacgcatggttttcagggcgttcgatttatgaaaattcggtgagccgggtccgccagcctcgacatactgttcatcccagccattttgaaaccagatgatcagcatccctgccgctcgcgctgcggtcacggcggtttgaatgttggcaatgaccgggcgagtggttgagacatcaaacccggcgagatctaagtagccgcctggcgtggcataagcgttttgcatatccaccacgatcagcgcactttgctgcggatcgaaggtaatggcttccggtcgagcggttaaggtcgtcatcatgccacctcctgagtcagcgcaggtagatgggcgcggcattgcatcagtggttgaatgcgctcgccgaaggtttcgattcccgacagaaaatcgtcgaaggttaacagcacgccttcggcaccaggcacgcttgcgacttcatctaacatgcgcgcgacactggcgtaagaaccgactaacgtccccatattgatgtttaccgccgaagtgggatcggccatctgacgaacgttggtgtcagtaccggagcgggtatctttctgactttgttcggttagccagcttaacgcctcttcatccgcgcccgctttgtagtgttcccatttggcgcgagcggcatcgtcggtttcatcggcaatcaccataaacaacacataagagccaacgtcgcgtccggtttgctctgcggcctgtttcatccgcgcagcggtcggggcgaaagccgtgggtgtatttacgcctttgccgaaacagaagttgaaatcggcataccgggcggagaacgccatgccagcgtcgctttgcccggcgcagatcactttcatggggacactcggttgcggactcacgcgacaatcattcatggtgaaaaaatcgcctttaaaatcgcttttccccgtgccccacaggtcgcgcagcacctgaacatattcggtgagatagtcgtaacgacgggagaaatagtcatcgccaggccagatacccatctgctcatactcgggcttttgccagccagtcacgaggttgacgccaaaacgcccgccagagatggagtcgatggttgcggccatacgggcgacgattgccggaggtaacgttaaggtggcagcagtggcgtaaatctgaatgcgcgaggtcacggccgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaaggtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtattggcttgtttgcaaagcggatgccagtttttaaaaagttaatgttattaatctgttaacattacgttatctaaaatatctggtaaaaagtggactaaacggtcaaaacagttgcacataaaacatgcatctgtgcgcgatgagagtgcagaaggtcgaggccgggcgggggttttgctatcctgttgccaatctacaagaggggagagcgcatgacgcaaggcgcagtgaaaacaacgggtaaacgttcgcgcgcagtaagcgcgaagaaaaaagcgattcttagcgcagcactggacactttttcacaattcggttttcacggcacaaggctggagcagatcgcagagttggcgggtgtttcaaaaaccaatctgctgtattactttccgtcaaaagaggcgctgtatattgccgtgctgcggcagattctcgatatctggctggcaccgttaaaagcgtttcgtgaagatttcgccccgctggcggcgatcaaagagtacatccgtctgaagctggaagtctcacgcgattatccgcaggcttcgcgcctgttctgtatggagatgctggcaggcgcgccgctgttaatggatgaactgacgggcgatttgaaggcattaattgatgagaaatcggcgctgattgccggttgggtcaaaagcggcaaactcgcgccgattgatccgcagcatttgatttttatgatttgggcttccactcaacattacgccgatttcgcccctcaggtggaggcggtgacaggcgcgacgttgcgcgatgaggtatttttcaatcaaacggttgaaaacgtgcagcggattattattgaggggattcgaccacgttaaagatgccggaggaggttgtaacatcctccggctacctgtttaacctatagtcattaagctggcgttaccgccagcggcagcggtattcacactcagcgaacgctcgatatacagccgttccagaaggatattgctttcgccacgggcaaaaccctgcaccgaaacaattgtgccatcccgcgcggcaactgcttcacacaatgcgcgaagctgatccgaatcaccgtggaagatcaccgcatcaaacggttgagcggttatattttccgctttcgccagttgaatacgttcgctgactgccgatggcaatgccttcactaactgacgatgcagcgcgtcatccggccacagtacctggctgcccaccgccagcacggcggcgagctgagtcagcgcatcctgctcatcatcggcaatacacaacacgcgctcacgcggcagcagcgtccaggtgttgcgttcacccgtcggccccggcagcaatcgttgtgttcctgcctgcgccagctcgccatattgcgtacataacgcctgcaattctggacgatttgctgcccattcccgcagtgcatttagcggctgagtcaatgcggctttcaactgcgcatcgaccggatactttgcatcctgacgcgcgagcgtcactgccagcgcactttccgggcgattcgccagcagacggtagagatagagcggaccgcctgctttcggcccggtaccggacaacccttcgccgccgaacggctgcacaccaaccactgcgcccaccatattacggttaacatacaggttaccaacatgggccgagccagtgacctgggcgatggtttcatcaatgcgcgtatggacgccaagcgtcagaccataaccggaagcgttaatctgctcgatcagctctggtagctggttacggttgtaacgcaccacatgcagcaccggaccaaagacctctttttgcaattcggcaaagtcatccagttcgatcagcgtcggggcgacaaaggtgccgctttgccattcacgggcatcttcgctgttttcccgcaccgcctggaacaccggacggcctttgctacgcatggtctgaatatggcgctcaatattggctttcgcttcgctatcaatcactggaccgatatcggtggtcaggcgacccggattacccatccggcattcggccattgcgccgcgcagcattttcaacgtgtggtcggcaatctcatcttgcaggcacagcacgcgcagcgccgaacaacgctgacccgcactgtcgaacgccgaggccagtacatccacgacgacctgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgcacgcgatcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcggcgatctgcccggtgaaaatagccagcgggaagttccacggactgatacacaccacaggccctaatggacggtgggtttcgttagcgaaatcatcccgcacctgtccggcgtagtagtggagaaaatcgaccgcttcgcgcacttcggcaatggcgttactgaaggtttttccggcctcacgcaccagaataccaatcagttgctgcatctggctttccatcagcacggcagcgcggtgcaaaatcgctgcgcgttcagccggaggcgtggcaaaccagattggcgcgttattaaccgcactttccagcgcctgttctacttcacgcggcgtggcttcacgcacatagcccacaatatctttcggttccgcagggttaataacgggcgacatctcacctgccgctaccggttgttccagcattggcaaggcctgccatttttgcagtgcactattgagcagggcagaggagagcgaggccaggcggtgttcgttagcgagatccagccctgccgagttgtcgcgcccgtgaccgtaaagatcgcgcggcaggggaattttcggatgcggtaatccagtttgcccttcctgttgcgccagtttttctacagcagtgaccggatcggcgaccagttcatccagtggcaaagaggtgtcggcaatacggttaacaaacgaggtgttagcaccgttttccagcaggcgacgcaccagatacgccaacagcgtttcatgtgtgccaaccggagcataaatacgacacggacggttaagtttgccgtcggcaactttcccggtgacctgctcatacagtggctcgcccataccatgcaggcactggaactcgtactgacccgggtagtagttctgccccgccagttgataaatcgccgccagcgtatgggcgttgtgcgtcgcgaactgcgggtagattagattcggcaccgccagcagctttttcgcacaggcgagataagaaacgtcggtatacaccttgcgggtataaaccggataaccttcaaggccgtccatctgcgcacgcttaatttcactatcccagtacgcgcctttcaccaggcgaatcatcagacggcgacggctgcgggtggcgagatcaatcaggtaatcgatcaccaacgggcagcgtttttgataagcctgaataacaaaaccgatgccgttccagcctgccagttccggctcgaaacagagtttttccagcagatcgagggagatctccaggcgatcggactcttcggcgtcaatgttgataccaatatcgtactgacgcgccagcagggtgagtgatttcagacgcgggtaaagctcttccattacccggtcatactgggcgcggctataacgcggatgcagcgccgacagtttgattgaaatgcccggcccttcatagatgccacgaccgttagacgctttaccgatggcgtgaatcgcctgctgataggaaaccatatacgcctgtgcatctgcggcggtcagcgcggcttcgcccagcatatcgtaagagtaacggaaacctttctcttccagcttgcgggcattggctaacgcttccgcgatggtttcgccagtgacgaactgctcacccatcaggcgcatcgccatatccacacctttgcggatcagcggttcaccgcttttaccgataatgcggttcagcgagcgggagaggctggcttcgttatgggtggaaaccagtttgccagtaaacagcagcccccaggtggcggcattaacaaacagtgacgggctacgaccaatgtgtgactgccagttaccgttgctgattttgtcgcgaattaacgcgtcgcgggtggctttgtcgggaatacgcaacaacgcttccgccagacacatcagcgccacgccttcctgcgatgacagcgaaaactcctgcaataacccctggaccatacctgcgcgaccactggcatttttttgattacgcagtttatcggccagctgatacgccagtttgtgcgcctgttcagcaactggctgcggcaggcgggcttgttccagcagcatagaaaccgcttcggtttccgggcggcgataggccgcggtgatcgcggcgcgggaaaccgactggggcaatatttgctcggcaaagtcgaggaatggctggtgtggttcctctgccggagtcggtgcttcatcgctctcattggccgcgccagaaagcagcgcaggtagctccggcagagtatcgctgttttccagttgttcgagataagaaaaaatcgcctgcttaattaaccagtgtggtgtgcgatcgatacgtgtcgcggcagacttaatacgctcacgcgtcgcgtcgtccagcttaacccccatggtggtggttcccatgccattactcctgttgttcagaaaggtgcaacttaacgttatcgtgaaatatccatgatgttgcaactttgtgcaaccatgttaaatgtgacatgcgtagcaagcttaaaaatgaatgaaatgttaataaaagaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaactttgacgactatattctgggcggtcgtagtcttgggccattcgtgacggcattatcggcgggtgcgtcggatatgagcggctggctgttaatggggttgccgggcgctgtttttctttccgggatttccgaaagctggatcgccattggcctgacattaggcgcgtggattaactggaagctggtggccgggcggttgcgtgtgcataccgaatacaacaataacgccttaacactgccggattatttcaccgggcgctttgaagataaaagccgcattttgcgcattatctctgcgctggttattttgctgttcttcaccatttattgcgcttcgggcattgtggcaggcgcgcgtctgtttgaaagtacctttggcatgagctacgaaacggctctgtgggcgggcgctgcggcgacgatcctttacacctttattggcggtttcctcgcggtgagctggactgacactgtacaggccagcctgatgatttttgccctgatcctgacgccggttatcgtcattatcagtgtcggtggctttggtgactcgctggaagtgatcaaacaaaagagcatcgaaaacgttgatatgctcaaaggtctgaactttgttgccattatctcactgatgggttgggggctgggttacttcgggcagccgcacattctggcgcgttttatggcggcggattctcaccacagcattgtccatgcgcgtcgtattagtatgacctggatgatcctctgcctggcaggggcggtggctgtcggcttctttgggattgcttactttaacgatcatccggcgttggctggtgcggtaaatcagaacgccgagcgtgtgtttatcgaactggcgcaaattctgtttaacccgtggattgccgggattctgctgtcggcaattctggcggcggtaatgtcaaccttaagttgccagctgctggtgtgctccagtgcgattaccgaagatttgtacaaagcgtttctgcgtaaacatgccagccagaaagagctggtgtgggtagggcgtgtgatggtgctggtggtggcgctggtggcgattgcgctggcggcaaacccggaaaaccgcgtgctgggcttagtgagctacgcgtgggcaggctttggcgcggcgtttggtccagtggtgctgttctcggtgatgtggtcacgcatgacgcgtaacggtgcgctggcggggatgatcatcggtgcgctgacggttatcgtctggaaacagttcggctggctgggactgtacgaaattattccgggctttatcttcggcagtattgggattgtagtgtttagtttgctgggtaaagcgccgtcagcggcgatgcaaaaacgctttgccgaggccgatgcgcactatcattcggctccgccgtcacggttgcaggaaagctaagggacttagcctgcggcggttttgtttggcttcagcagcgggttgcgctcccttaatgtgcctcgccatataaattgaatggtgcagggagcgcgcagggggcggccaatcgccgccgccccctgctgtcccggccttcggggaacgcttcagcgattttgacgccaccaacacccgagctgttattatgttccgggcaaaaagttagatttgataatcgcggatggacgaaattgcttgatacacccgcttatcagttttacatggaagctctgatgcattgagtctggacagttttgtcggctggatacggcgtttacgcggcatccggcaagaacacatggttctttgcaaacaatcccatctttctaccctggaataatcgtttatatcccttggcattacctctctttgtttacattccaacatcattttataaacattccgcttgtgtttttctttgccgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattgtgtgatgtggattggcgtgttgcttgccgctgcgttgtgcctgggcttgggtatcttcattaacgaaaccaccggcgaatttccgcaaaaagaacaggaactgtttgaaggtatcgtggcggtgatcgccgtggtgatccttacctggatggttttctggatgcgcaaagtgtcgcgcaacgtcaaagtgcaactggaacaggcagtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgctcggtcttgctactgccgtggtgctaggcttcctgctctactggggcggtattcgcctcaatcttggtgcattttttaaatggaccagcctgtttattctcttcgtcgccgcagggctggcagctggtgccattcgcgcatttcatgaagccggattgtggaaccactttcaggaaatcgccttcgatatgagtgcggtgctctcaactcactcgctgtttggcacgctgatggaagggatttttggctatcaggaagcgccgagcgtcagcgaagtcgccgtctggtttatttatctcatcccggcgctggtggcatttgctctgccaccacgcgcaggggcgacagcgtctcgctccgcgtaacaaatacgacgcaaactcttgcttagttacaacatactttaaagggatagtctcgtcatgaccattaacttccgccgtaacgcattgcagttgagcgtggctgcgctgttttcttctgcttttatggctaacgccgctgatgtgccgcaggtcaaagtgaccgtgacggataagcagtgcgaaccgatgaccattacggttaacgccgggaaaacacagttcattattcagaaccacagccagaaggcgctggagtgggagatcctcaaaggcgtgatggtggtggaagagcgggaaaatatcgcccctggctttagccagaaaatgacggcgaatttacagcctggcgaatacgatatgacctgcggtctgctgactaacccgaaagggaagttgatcgtcaaaggtgaggcaacggcggatgcggcgcaaagtgatgcgctgttaagtcttggtggtgcaattactgcatataaagcgtatgtcatggcggaaaccacgcagctggtgaccgacaccaaagcctttaccgacgcgattaaagcaggcgatatcgaaaaagcgaaagcactgtatgcaccgacgcgccagcactatgagcgtattgaaccgattgctgaactgttctccgatctggatggcagcattgacgcccgtgaagatgattacgagcaaaaagccgccgacccaaaattcactggtttccaccgtctggaaaaagcattgtttggcgacaacaccaccaaagggatggatcagtacgctgagcagctttataccgatgtggtcgatttgcaaaaacgcatcagtgaactggctttcccaccttcaaaagtggtcggcggcgcagccggactgattgaggaagtggcagccagcaaaattagcggtgaagaagatcgctacagccacaccgatctgtgggatttccaggctaacgttgaaggctcgcagaaaattgtcgatttgctgcgtccacaactgcaaaaagccaacccggaactgctggcaaaagtcgatgccaactttaaaaaggtcgataccattctggcgaaataccgtactaaagacggttttgaaacctacgacaaattgaccgatgccgaccggaatgcactgaaaggaccgattactgcgctggcggaagatctggcgcaacttcgcggtgtgctgggactggattaagcgttatgcagtataaagatgaaaacggcgtgaatgaaccgtcacgccgacgtttactgaaagtgataggtgcactggcgctggcgggaagttgtccggtcgctcatgcacaaaaaacgcaaagtgcgccgggtacgctttcaccggatgctcgcaatgagaaacagccgttttatggtgagcatcaggcagggatcctgacgccacaacaggccgcaatgatgctggtggcgtttgatgtgcttgccagcgataaagccgatcttgagcggttgtttcgcttgttgactcagcgttttgcttttctgactcagggcggagcagcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagctgcagaagatgacgcgtttccccaacgactcgctggatgcggcgttatgtcatggtgatgtgttgctacagatttgcgccaacacccaggacacggttatccatgcgctgcgcgatatcatcaaacacacgccggatttgctcagtgtgcgctggaagcgggaagggtttatttccgatcacgcggcgcgtagtaaaggcaaagagacgccgattaatttgctgggtttcaaagacggcactgccaatcccgatagccagaatgataagttgatgcaaaaagtggtgtgggtaacggcagatcagcaggagcctgcgtggacaatcggtggcagctatcaggcagtacgcttgattcagtttcgagtggaattttgggacagaacgccgctgaaagaacagcagacgatttttggccgtgataagcaaaccggtgcgccgctgggaatgcagcatgagcatgatgtgcctgattacgccagcgacccggaagggaaggtgatcgcgctggacagccatatccggctggcgaatccccgcacggcggagagtgagtccagcctgatgctgcgtcgtggctacagttattcactgggcgtcaccaactccgggcaactggatatggggttgctgtttgtctgctaccaacacgatctggaaaaaggcttcctgacagtacaaaaaaggctcaatggcgaagcgctggaggaatacgttaaacctatcggcggcggttatttttttgcgctgccgggggtgaaggacgcgaacgattatttcggaagcgcgttattgcgggtttaatgtttttaggcggataaggcatttgtgcgcagatgcctgatgcgacgcttgcgcgtcttatcatgcctacaatcagtgcgggtttggtaggctggataaggcgttcacgccgcatccggcgatcgtgcactgatgcctgatgcaaatcctgctgaaagcacacagcttttttcatcactgtcatcactctgtcatctttccagtagaaactaatgtcactgaaatggtgttttatagttaaatataagtaaatatattgttgcaataaatgcgagatctgttgtacttattaagtagcagcggaagttcccggcagtgatagtcagtcactatggagatcgcggatggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaagtgtgttatcggtgcagagcccgggcgaaccgggctttgttttgggtgtttatgcccggactagcgctttttctgaaacaaccatttttatttgcccctggctggtgaagtgtacgctcatcctgtggcttttttgtagttgctgatagagctcatcaggtattgctaagctctctgcatattcttgcggcgtatattggtaggctgcatgatgctgctgtttttgaaaacgcagcttattgtacagcgcccagacaattaacacgacggcattcgccactgccagcaaaaaatagaactgaagtcggcttctggcctcgctttgccagtaataacccgtcagcagatccatggcgaataagaatatgaacaacgcaaataatgtccacaagatggttgtggcaacataatcaaccagtaaacgtactggtgattgtcgggtcgtaataattaaattgttcatattaacctctcagaatcccgcgatcgggacttacccaacgggcgcgttgctttttaggcatcaacatgactcgtgtaaatgataccaatgtcgttgccaggctcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaggtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagtgcccgtggctcgtaaaaaatcgtccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaaatggggaatttgtgcagccatgcgatccaggatggcacgggttttatctgttgaaccgtcatttacggcaataacttcaatgttctcataacgctgtgctaaagcggcgtgtatggtttcctcaacgtttttctcctcattaaaacagggaatgataatggagatagacggattatctttcaactggggagctggtgcgttttctccccacggccagtggcgttcacgatagacccagaaatagacgccgccaacaatccacataatggacataaaaaacggccagaagaaaacgaacctcatcatcagttcaccagagtgaaagtacgctacgcataggggtatgcataacaccagacataatataaaaaacgatacgatgcgattaatcatttttcggataccaggctgttgaaaactcaggacgaataaggtctatttcaggttggttatgcagaaaattgtcgggataataaccatagtttttcactccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccagataaggcatagccataatagcggtccagtcatagctttttaggaaatcagcataattctgtgcaaaccaggcttcactttcaggttgtattaccggaagtgcaaaaatatttcgtgcagttttaatatgtggaccgcgaatggcttttacgcgcgcactaagttctaaagtgaagtcagttaacgcacgacttttaaagcgggcccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggtgatattgttcaggatgaatttgtgcttttttctcccctgttggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgaagaacatgtcataaccgagtttttttaattcctctatcgctatgccattcgcttcgccataaggccaaacaaaaacgtgtggatttacctcaacctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgagctcaacgagccgggaacgcgcaacttctcgcacttgttgccacgtggcaaaatattctcgatcgaccaactcatcgccaaattttacttgtttatccgctggcgtatcgacccaactgccgacgggggcccatacagcaggccactggaaggcctgaagaattgggaagacgcgggtataaaaactctggtagccgtcatcaaaagtcagcactacagctttttccggtagcggttttcctcctcgatgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgctacaaaaccattatgcggccacggttgctcggcgagtaaagattcgcgatcctgtggcggtataaatgatgttcttgactggctaatgcacgcggtgagcataattatactcaccagcatcaggagatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccaactaatgcgttgcccgtagccgagttgggtgacgacatccgtgccataatgtttttgccaggaggcaccaacacctgcgctgaatatttgctcccagctattttcatagcttcgccataacaaatggcttgcctcaaatgccggaacaatatcgaacgtttttatagggttgtagtatggggtatcgtgttctgtattttgttcgtaatacagactgggtaggaaatcgacaatcaaatatggtgaagaccagatgcgttcctgaccctcaagtgagacttcatgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactctgcctcgagccagatattacgtgaccgccactcaacacccgcaagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgagccagcgatacgaagctctgcaagattatgtacatcaaccgcacgttttaatcgtacaacgccgggatcttgcggttcacgttcgacaacatcgtgcgttaagacagctgcctgctgccattcttgtaacgttaatgctgtccaggcttgttcaacctccagattaatattacgtggctcgatcacttctgctttttttaattcattttctgctgcacgaggccaaccgcgggcttgtaacacactcgcgtaatcaatgcgcagtccctgatttcctggtgcgttataagcaagctctctggctgtcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgcccggataattttcactctccaggtggctgtaaaagagatccgcaagttcttcatcggataaatccggggcaatggtctccttgtgataaaagagctcggtcattattgactgtgcttttttcggctgatgatctttgagataagccgatgcaacccaatattgcccccagggcggaataatttgccccgtcttttttaatcgctgatagtgagaaataacgtctttataacgatcgcgagttaataacgcgccaagatgatcaacctgaatacgctggtactgggcagtgcggtctgggttatcgtgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattacgtaatgcctgcacgtattctgtgggatattgttgcgtagatgcattttcaggtaatgactctgtcatcgcccgtaattcatcctgatgacgccccgccagtttatagatataggcttctgcgagtaaattggctttgtccggtgctccagagttaagctgcttaagtttaaccagcgcagtatcatagtgaccagcatctgccagggttaaaatttgtccccgttgataatccttattttgcggctccagagagagcgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattgctgagtgctgattttagtgcaaaccatgacaaagctggctgagtattacccttgcgagcttcaataatcaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctgtatctaattacaggtaactgaaaagaaagatatttttgcacctcataatccgttattaaacgcggaagagagacgtgaattgttgatgatgagaagaagaaatgatgagcagagtgtccatataaaatccttttctcgcccgaaaatccattccaatgatgaggatcttcaggaatacggcataaatcccaatgcctttttcaaaataaattaggattaaaataattaaatcagtaaattccgatgcatgatttcggatttttcgaaagtcctgatgaaaggctgcgctacggcactcacggatttaattgttattcctaatgtatctatgaattaatgttttataaggattttctataaccatttataagtattttcaagcctggcttgttgcaaacaatgtataaagcacttaggcaataataattacattcagcaactatcatcatcggtattgtttgtgggcggaatttcatattgacaacagtacagttcttatatctattaataatagaaagggatctacaacctacagattggtgtagctttatggaaaaagactatttgagaattagtagtactgtattagtgagcttattgtttgggcttgctttggttttggtgaatagttggtttaatcagccaggcgttgaggaagttgttccacgatcaacctatctgatggtaatgattgctttattttttatcgatactgttgcatttatttttatgcagttgtatttcatttatgaccgtaggcaattttcaaactgtgtacttagtttggcttttctgagttgtttgatttactttgttataaccgtcattatcattcagcaaattattgaggagcgtttgacaagcagtgttgtccaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgtttttggggggccgatagttgctcacatactttctagtcattatgagagctacaatttacacattgccgagttaaccaatgaaaatggtcaggtggtttggaaagcctcatatgttaccataatgattttcatgtggttaaccttgctttcggttaatctatactttaatggtttacgctatgatatctggaatggagtgacggtgattgctttttgtgccgtactgtacaatatctctctgttatttatgagcaggtatagcgtgtccacttggtatattagtcgcactattgaagtagtcagtaagttaaccgttatggtaatatttatgtgccatatattcagtgcgctacgagtaacaaagaacattgcacatcgcgatcccttaaccaatatatttaacagaaattatttttttaatgaactgacagttcaatcagcatcagcccaaaaaacgccttattgcgtcatgattatggatatcgaccacttcaaaaaagtcaacgacacctgggggcatccggttggcgatcaggtgataaaaacagtggtgaatatcattgggaaaagcatacgaccagatgaccttttagcgcgcgtcggcggcgaagagtttggcgtcttgctgacggacatcgatactgaacgtgcgaaagctttagcggaaaggattcgggaaaatgttgagcgtttaactggcgataatcctgaatacgctataccacaaaaagtgacgattagtattggcgctgttgtgactcaggaaaatgcgttaaacccaaatgagatctatcgactggctgataacgcactttacgaggcgaaagagaccgggcgtaataaggtggttgtgagggatgtggtgaatttttgtgagtcaccataaagcggcattttgatcctacccacgtaatatggacacaggcctaagcgaggttcttgttttcaaattgttccggactgaggccgccacaccaactgtgccgccgccaccgattgtaatcacattcgatataattaaacaccgttgcccgcattatttcccggctgataaagtgttctccatggatacattccactttcagcgaatgaaagaagctttccacgcaggcattatcgtagcagcaaccttttgcgctcatacttccacgcagattatgccgcttcagttgcgcctgataatctgctgaacagtactggcctccacggtccgtgtgaacgataacgttccggggcctcttacgccgccacagcgccatctgcagggcatcgcaggccagttgcgccgtcatgcgtggcgacattgaccagccaataacggcacgtgaccacaggtcaatgaccactgccagatacagccagccttcatctgtacgtaagtacgtgatgtctcctgcccacttctggttcgggccactggcgtaaaaatcctgctccaacagattttctgacacaggcaggccgtgtgcgcggtagctgaccgggctgaacttccgggaggcctttgccctcagtccctgacggcgcaggcttgccgccacggtttttacgttaaaggggtaaccctgagcacgcagttcatccgtcaggcgtggggcaccgtaacgctgttttgaccgggtaaaagccgcgaggacaacgctgtcgcagtgttggcggaactgctgacgcgtgcttatccttgtccgccgctgacaccacgtataccagccgctgcgggccacccggagcacgcggcacattgctttgatgctgaactcagcctgatgtttttcaataaagacatacttcatttcaggcgcttcgcgaagtatgtcgcggccttttggaggatagccagctcttcatcccgttctgccagctggcgtttgagacgtgcaatctcggtagacatctccagttcacgttcagaagacgtctgctgattttgctgtttactgcgccagttgtagagttgtgattcatacaggctgagttcacgggctgcggcagtaacaccgatgcgttcagcaagcttcagggcttcactgcgaaattcaggcgaatgctgtttacggggttttttactggttgatactgtttttgtcatgtgagtcacctctgactgagagtttactcacttagccgcgtgtccactattgctgggtaagatcagtgcctggcacacgcgtttgatggaagacggcgttcaggcaatgcgcgattatcttgccggactggatatcgcttcgccagagcatcaggttctgatgaacgtaacagcaaaaagcgaggtcgctccgtcaattatcaaagaaaatctctcattacacttaactcatacggtgaaatggactgaatctctcgatacatttctgaatatgccaaccccggtagctttccttgaaataagtaataagccctatttggggaatatgttaaatgattttgctggcgtggatcagcaacgagttatgcattgtcgtaaagcatttagtgatgcaaaggtattcaaatgattcctgattatttaacttttattcgctttcaggataaacgaaatctgatatacatttatgctattggacttattctgataggcttttattggaagaatgcagggtttacttttccatcagaggatattggtgtagttagtgggattctggctctggtgctgtataattttatttttgatctcaaggcgtactgggcttataaatgcgtcacgaagaatatcgatttttcgtggtttaagaaaaagcagaaccacaaaatagaattatttcttacacaacctctggtggcaggatttctgtcgttaatcatgttgagtgcaatgagttgggggctataccagcttctaccctcgttatatgcgctgttcctgatttcgttacttgggccgttggtcatctttctgctgtttcggatgatccgcaccagttatgtcaagcaggtcgctatttcagtagcgaaaaaagtaaaatataaaagtctgactcgctatgtgctgctttcggtgtgcatctcaacggttgttaacctgcttactatcagcccgttgcgtaacagtgattcttttgtgacagaggggcagtggttaacgtttaaatcgataattgcattgctcattctttgtggcgtagtgttggcgattaatctgttttttctgcgcttctccaagcggtacgcttttctgggcaggctttttttgcaggaaatcgatctgtttttctccagtgaaaatgcgttgtcgaccttttttgccaagccgctttggcttcggttattcatattgctggttattgaagtgatgtggattacgctggtgtcggtattggcaacgcttgtagaatggcggatttggtttgaagcctattttttactctgctatgtaccgtgcttaatttactattttttctattgtcgattcctctggcataacgattttatgatggcatgtgacatgtatttccgttgggggcattttaataagtgaggaagtgataggaagtgaccagataatacatatatgttctgtactctcttgcgcattttgattgttgactgagtaaccagacagttgatgtgcacgatttcccctcgccctaacagacgtgggcgggggcacccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgacccccggtcggggcttctcatccccccggtgtgtgcaatacacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattgactcgcttcgctcgccctgcgggcagcccgctcactgcgttcacggtctgtccaactggctgtcgccagttgtcgaaccccggtcggggcttctcatccccccggtgtgtgcaatatacgaaaaaaaagcccgtactttcgtacgagctcttctttaaatatggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaactttttgaaaaaatcgcgcgtttattcaaacttcaatcaatgtgtggttttaataagcgaaatctgctttttttgccaccgaccacggatttgttatgctggtggcctttgtagatcataacgataagtgcgaataaatttcgcacaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctcctgttgaaatgctggcagggcgcgatcttaaagcggtgttcgcactcggggccggtgttgattctattttgagcaagctacaggcacaccctgaaatgctgaacccttctgttccactttttcgcctggaagataccggtatgggcgagcaaatgcaggaatatgctgtcagtcaggtgctgcattggtttcgacgttttgacgattatcgcatccagcaaaatagttcgcattggcaaccgctgcctgaatatcatcgggaagattttaccatcggcattttgggcgcaggcgtactgggcagtaaagttgctcagagtctgcaaacctggcgctttccgctgcgttgctggagtcgaacccgtaaatcgtggcctggcgtgcaaagctttgccggacgggaagaactgtctgcatttctgagccaatgtcgggtattgattaatttgttaccgaatacccctgaaaccgtcggcattattaatcaacaattactcgaaaaattaccggatggcgcgtatctcctcaacctggcgcgtggtgttcatgttgtggaagatgacctgctcgcggcgctggatagcggcaaagttaaaggcgcaatgttggatgtttttaatcgtgaacccttaccgcctgaaagtccgctctggcaacatccacgcgtgacgataacaccacatgtcgccgcgattacccgtcccgctgaagctgtggagtacatttctcgcaccattgcccagctcgaaaaaggggagagggtctgcgggcaagtcgaccgcgcacgcggctactaataaagcatcaggattcctgctatccttggcgggaattgaatacaggagagagttatgtatcccgtcgaccttcatatgcataccgttgccagcacacatgcatatagcacattaagtgattacattgcccaggccaaacaaaagggcattaaactttttgcgatcaccgatcatggcccggatatggaagatgcgccgcatcactggcacttcattaacatgcgtatctggccgcgagtggttgatggggtagggatcctgcgcggcatcgaagctaacattaaaaatgttgatggtgaaattgactgcagcggtaaaatgtttgactcgctggatctaattattgccggttttcatgagccggtttttgcgccacatgacaaagcgaccaatacacaagcgatgatcgccactatcgccagcggcaatgtgcatataataagccatcccggaaatcccaaatatgaaatagatgtgaaagccgttgctgaagcagccgcgaaacatcaggtggcgctggaaatcaataattcctcatttttacactcacgtaagggcagtgaagacaactgtcgtgaggtagccgcagcggtacgtgatgctggaggttgggtggcattaggctcggattctcacaccgcgtttaccatgggggaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccacaagatcctttactggtgccgctgtttaccctgattcgtgaggggaaactggctgcgaactggccactggagcaggatgagttgctgacacgtttgcagaaaagctgtgatatgacgcaagtctctgccgattacaatgcgttgtttatcggcgatgaatgtgctgtgccgccatatcgtagcgcatgggttgagggcgcgacggaagcggaagtgcgcgcttttctttctgagcgagggatgccattagcggatacgccagccgatcacatcggcacattgctgctcgcagcttcctggctggaagatcagtcaacggaagatgagagcgaagcactggaaacactgttcagtgagtatctgttaccctggtgtggtgcgttccttggcaaagtggaggcccatgcaaccacgcctttctggcgcaccatggcaccgctaacccgcgatgccattagtgcaatgtgggacgagctggaagaagattctgaagaataagtgtgatctacgtcactcataactgcaacggataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccggggacgtttataggcgcatgcgcgacgtttgccgggcagggtgactggaaactggtgttaccttcgctggcgcttgggctgatatttggttacgcaatgaaaaacagtggcctgtggctggcggcgcgtagtgcaaagacggcgcaccgtgagcaggaaatcaaaaataaagcgtgaggggcactcacgctttcgcttaaacagtaaaatgccggatgataattccggcttttttatctgtcaggattccggtggaaccgacatatggcggtatttcaccagaatgtcattctgccgttctgctttattttgcaaatcccacagaccacggtcgataccatcattaatcaggaaaatgacccctgtttcgatagccgacatcaggcacagcataacaggttcgttcgaggtgtaacccacttccccttcaagcaagcgctggtagtcaataaagcggaaaaccccggcctgaacttcataggaaagtatcgtcttactggtgttcaccgaagaaaggatctcgccggtactcacattgacgacgcgcaggttcacggcaatctgatcgagctggtattgcgtgtcggcaccgatgccaaaatatcttgccccaaccccgccagatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcagtgccgtgaccagcattgccgtggcgctttgcggaacagcagtggagaagttacttgccgggtagggtttaaattgcccggtttcgtcctgaatgttgtataccgaaacaaagattttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttggcaatatcgacaatataatcgttggtcaccatgcggcccggtttaccggtattaatattcgacagtagcccacctaaaatttgtgactggatggcctgagtaaagttatctaacgctgagggtgtttcaataccaaagtcatcgttatagctcggatctttataagagttttgggcctgagcgctatttaataaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttagaattcatcatgcgccaaatcgcccgtacttaataacgcctgatttatctggcgacgatttagtgcttcttcagtttgaatcagtgcaaagacgacagttttctcgaagtctcttttcaacggaaataaaaaagtctggaaaataacgtcctgattgaccgttatagtgatccagcttccccatcgtgcactgggcctttcattaatcgttaagttacccgtatagtcactttcccatttatcactaaaggctcggtaaaaatcatggccaatagatgaaacagtatggtcagttagcaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtagctggcaagcttttgcgtaaagtagcattcgccgcgcaggacgccttgcaacccattgacaacacgttcttgatcctccatggaataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagagatatcgtccagagaacgttgaatattatgtaattttcctgtaattgccagcgattgtttaaggtgctgcaagagagctgtcgcctgcaaagaagatttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcgttatattaaaatgttaaccttaaggttttattaagtttagaaatgatagaaaagttgtacatttggtttttattgcacaattttaaaaaatcatacaaatggtgataacttactaataatgcatataaaaaatatttcggtgtagtcctttcgtcatgtaaaacgttcttgttttttctccacacctccgtggacaattttttactgcaaaaagacgaggtttgtcacggcttgtgcgcaagacatatcgcagcaatcagcgacgggcaagaagaatgactgtctggtgctttttgatagcggaaaacggagatttaaaagaaaacaaaatatttttttgcgtagataacagcgtatttacgtgggttttaatactttggtatgaactaaaaaagaaaaatacaacgcgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataacttcgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcagtgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctccggtagcgctctggcaggtgttgttcctcagtacggcggcggcggtaaccacggtggtggcggtaataatagcggcccaaattctgagctgaacatttaccagtacggtggcggtaactctgcacttgctctgcaaactgatgcccgtaactctgacttgactattacccagcatggcggcggtaatggtgcagatgttggtcagggctcagatgacagctcaatcgatctgacccaacgtggcttcggtaacagcgctactcttgatcagtggaacggcaaaaattctgaaatgacggttaaacagttcggtggtggcaacggtgctgcagttgaccagactgcatctaactcctccgtcaacgtgactcaggttggctttggtaacaacgcgaccgctcatcagtactaatacatcatttgtattacagaaacagggcgcaagccctgttttttttcgggagaagaatatgaatacgttattactccttgcggcactttccagtcagataacctttaatacgacccagcaaggggatgtgtataccattattcctgaagtcactcttactcaatcttgtctgtgcagagtacaaatattgtccctgcgcgaaggcagttcagggcaaagtcagacgaagcaagaaaagaccctttcattgcctgctaatcaacccattgctttgacgaagttgagtttaaatatttccccggacgatcgggtgaaaatagttgttactgtttctgatggacagtcacttcatttatcacaacaatggccgccctcttcagaaaagtcttaatttgttgaaatatcgagcataagatgaatctggagagaatggtctgctgcgaatcagccaacctgaaagtatggataacacaaccctcaaggatgactaatcattgaggaaatagaataaatgttcagaccttttttaaactctcttatgctcggcagtttgttttttccttttattgccattgctggaagcaccgtgcaagggggcgtgatccatttttatggccaaattgtggaaccggcatgtgacgtcagcacccagtcatcacccgtagaaatgaactgcccacagaatggttctattccgggcaaaacctactccagcaaagcgttaatgagcggcaatgtcaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcttgtttaaaagtcaggcaacagcagggcgattgccctacggggcatgccgttattacgcttgcaggcgatcttcccgctaaagccgtagtgcacaccgtcgggccagtctggcgtggtggtgaacaaaacgaagaccagcttttgcaggatgcctatctcaatagcctacgactggtggcggcaaacagctatacgtcagtggcttttcctgcaatcagtactggggtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttacccaacaaggagatgaatgatttgccccggctggcgagcgcggtgctgccactgtgttcgcaacatcccggtcagtgtggcctttttcctctggagaaaagtctggatgcgtttgccgcccggtatcgtctggccgaaatggcagagcatacgctcgatgttcagtattacatctggcaggacgatatgtcgggtcggttactgttttccgccctgttagccgcagcaaagcgtggcgttcgcgtccgtttgttgctggacgacaacaatacgcccggacttgacgacattttacgcttgcttgacagtcatccacgcattgaagtccggctttttaatcctttctcgtttcgcttgctgcgtccgcttggttatatcaccgacttttcccgtcttaatcgccgtatgcacaataaaagtttcactgtcgatggcgtggtgaccctggtgggaggacgaaatattggtgatgcctattttggagcaggggaggagccacttttttcggatttagatgtcatggcaataggacccgtggtagaggacgttgccgatgatttcgcccgctactggtattgcaaatcggtttcacccttacagcaggtgctggatgtcccggagggtgaaatggcggatcgcatcgagttacccgcctcctggcataacgatgccatgacgcatcgttatttacgcaaaatggaatccagtccatttataaatcatctggttgatggaacattgccgcttatctgggcgaagacacgtttattaagtgatgatccggcgaaaggggagggcaaggcaaaacggcattcactgttaccgcagcgcctgttcgatatcatgggctcacccagtgaacgcatcgatattatctcttcctattttgtaccgacacgcgcaggtgtggcgcaactcttacggatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggagccagcctgcatgctaaaacctttagcatcgatggtaaaacggtgtttatcggctctttcaatttcgatccgcgttcaacattgctcaatactgaaatgggcttcgtgatagagagcgaaacgctggcacagttaattgataaacgctttattcagagccagtatgatgcggcctggcagctccgtctggacaggtggggacggatcaactgggttgatcgtcatgcaaagaaagagattattctcaaaaaagaacccgccaccagtttctggaagcgggttatggtcagactggcgtcgatattgcccgtggaatggttattgtaaatgtggcttaacgggctggtgctttatcgttctcacgcttaacaaccggtttaccagagaacaaaaacttcagtaacgggatgcgcaaatgaatttcatacagaattatcgcaatccctactacaaatatcaggccacagagaaaaccaagccagttggaggtgatgtgcggtgtaatgtatgcgccgaaaaacagcgttaacgggtggtgaaccagatagataaacagcgatgcgttaacaaaataagtcacccgcgctgactggaagttaagcaaacggtggccaaaggagaagaccacattcaccatccacagaccgaggaccatggtgatcaccgactcggtttcgtacatccaggcatcgccactgccatagcgctggttgagtaaataagcgacaaacgccaatgctgctgcaagggtacagccacgagacggcgtggtaaacaaggctttaagatgagggaaaatgaaagccagtgcgccgaggataaagaacggcaaataaaacagcgtttgcatgacaataaaattgaacatgccattactcagaatgggcggatacacaataaaaatcgttcttcttattaccgcataaccgatgccgaggcataaaaaaatcaccgatagttttaccatcgagaattttttattcgttttatcagaattttctaaattatttctgatgcgcttaaatatccatacgcacagcgtcgtcatgaccactaacaccagtaaaaaccacaggtgtgatattaattcccaggccaacgtattatatttgtcatacaatgacagcccaggccaactttccgcttttcctttgacatattgcagcataataaattgcggtaatgtcagtagggggatggctgttaacatcgggatacctacacgttcgacacgtactttccaccattttttcaagggatagcgtaaaaaaagcatgtaggaaaagtagccggatataacgaaaaatacctgcatgcggaacgagtggatgaagtcattaaaaagggtcagccacaatgatgattcggcgctattcacatgccatgtatggctcgaatagattaaagaaatatgaaaaggtatccctaacaacatcagccaggcgcggatggagtcgaggaaatattcacgttgcgcgggtactgggttcatatatggttaactaatctcggatttttcgtcttatccctgtcgggttatgcctttaggcttgttgccatagtgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagcacggaaagtgaaaacggttgcaatcaggtgcttaatccatgagccagcgtgctgaacgataccgggattctgttgtcggaatggctggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatctttagccgggaaaggctacgagacgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagatacggtaaaagaccttggctttgccggttttaaagtgctttacccgatcaacagcaaagataaaaacgatgaaatcgtcagcatgctcggggccagctatttccgcgtgattggtgcaggtcaggtttatggcctttctgcccgcggcctggcaattgataccgccttgccatcgggtgaagaatttccgcgcttcaaagagttctggatcgagcgtccaaaaccgactgataaacgtttaaccatctatgcattgcttgactcgccgcgtgcgacaggtgcttacaaattcgtggttatgccagggcgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctctctatccatgccggtaatggcgaatggatctggcgtccgttgaataacccgaaacatttagcggtcagcagcttctccatggaaaacccgcaaggctttggtctgttgcagcgcggtcgtgatttctcccgctttgaagatctcgatgatcgttacgatctccgtccaagcgcatgggtgactccgaaaggggagtggggtaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtgataatggtgagatagttgaaagcacggtgcgctataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgattccccgcaaggctcggtaaaggcgcgtctggaacaagcctggccagattcacttgctgatggacagttaattaaagacgacgaagggcgcgatcagctgaaggcgatgccagaagcaaaacgctcctcgatgtttcccgacccgtggcgtaccaacccggtaggccgtttctgggatcgcctgcgtggacgcgatgtcacgccgcgctatctggctcgtttgaccaaagaagagcaggagagcgagcaaaagtggcgtaccgtcggtaccatccgccgttacattctgttgatcctgacgctcgcgcaaactgtcgtcgcgacctggtatatgaagaccattcttccttatcagggttgggcgctgattaatcctatggatatggttggtcaggatttgtgggtttcctttatgcagcttctgccttatatgctgcaaaccggtatcctgatcctctttgcggtactgttctgttgggtgtccgccggattctggacggcgttaatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcctgcgtgcaacgtgggaatcagtaaaagccaccgggaatgccaaacactttgatgtctacattcttagtgacagttataacccggatatctgcgtcgcagagcaaaaagcctggatggagcttatcgctgaagtcggtggcgaaggtcagattttctatcgccgccgccgtcgccgcgtgaagcgtaaaagcggtaatatcgatgacttctgccgtcgctggggcagccagtacagctacatggtggtgctggatgctgactcggtaatgaccggtgattgtttgtgcgggctggtgcgcctgatggaagccaacccgaacgccgggatcattcagtcgtcgccgaaagcgtccggtatggatacgctgtatgcgcgctgtcagcagttcgcgacccgcgtgtatgggccactgtttacagccggtttgcacttctggcaacttggcgagtcgcactactggggacataacgcgattatccgcgtgaaaccgtttatcgagcactgcgcactggctccgctgccgggcgaaggttcctttgccggttcaatcctgtcacatgacttcgtggaagcggcgttgatgcgccgtgcaggttggggggtctggattgcttacgatctcccgggttcttatgaagaattgccgcctaacttgcttgatgagctaaaacgtgaccgccgatggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtgcatgcgttgaccgaaccgcaatacttcctgcaaccacggcagttgttcccagtgtggccgcagtggcgtcctgagctggcgattgcactttttgcttcgaccatggtgctgttgttcctgccgaagttattgagcattttgcttatctggtgcaaaggaacgaaagaatacggcggcttctggcgcgttacattatcgttgctgctggaagtgcttttttccgtgctgctggctccggtacgcatgctgttccatacggtcttcgttgtcagcgcgttccttggctgggaagtggtgtggaattcaccgcagcgtgatgatgactccacttcctggggtgaagcgttcaaacgccacggctcacagctgctgttagggttagtgtgggctgttgggatggcgtggctggatctgcgtttcctgttctggctggcaccgattgtcttctcgttgatcctgtcaccgtttgtttcggtgatttccagccgtgccaccgttggtctgcgcaccaaacgctggaaactgttcctgatcccggaagagtattcgccgccgcaggtgctggttgataccgatcggttccttgagatgaatcgtcaacgctcccttgatgatggctttatgcacgcagtgtttaacccgtcatttaacgctctggcaaccgcaatggcgaccgcgcgtcaccgcgccagtaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgtgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagactttgtgggtcggataaggcgttcacgccgcatccggcaaaaacaacgagccaataaaaataccggcgttatgccggtatttttttacgaaagaggtatcaaatgcgtttaattgtggtgagcatcatggtgaccttgctgagtggctgtggcagcattattagtcgcactataccggggcaggggcatggcaaccaatattatcccggtgtgcaatgggatgtgcgtgactccgcctggcgttatgtcacgatccttgatctgccattctctctggtttttgatactttactgctgccgatcgacattcatcatggcccgtatgagtgattaacgttcatcccactcatcagctgctgcgcgtccttcctcggtatccagcggtggctcaagctgaaattccccctcgtcccattcatgtaatgtattctcttcctgccactcctggcgtatctctatctcatcatagtcgccatcaaaaacactttgcgcggcttcaccgctaagcataggtaaacattcaccttcttccccttcgtcggcaaaaaactcaacttgccacatgatgtcgccgtcctgcaaaacgtatttttgggcattgaactgttgcacattcgcatcttcggcgtcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatacctggggtattcgacgacgacgtagactgttccatgaatagactgcgttgaataacactacgccagcggtgacgagaaataccgctctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtagtgcaccatcggcggcaccgagcaaaaaacgtaaaatcccaagttgcaatggcgtctgaacgtaagacattgggatcaacagcagtacagaaaagatcagcgctgtaatcaggatcttttcgggtccgattcgatcgccaagtttgccgagtcgtggtgcacttagcagagccgccacgcctggcaccgaggcgatcatgccactgataaaggcgacgttactgacgttacccgccagttcgcggacatacagcgtcagaatgggggcaattgagcccgtcgccacctggatgattaacgtagtgacaaacaggctgagtaccagtttcgggtttttaagtgatgtcaccacttcccgcatgtgcagcatctcttttttgctgaccggctggaatttttctctgatgcaaaacagggtgacgaaaaagcagagtatgagcacactggcggtaataaagaataccggacgtaagccgtagctatcggcgagcaggccgccagccattgggccgagcaacgcaccactaacgccgcctgtggagagcgtacccagcgcccagccgcttttattacgcggtacttgtgtggcgataagagcattagcgttggggacaaatccgccaagtaacccaagaagcgcccgcaggatcaaaaactgccagatattttgtgccagccccatcaacaccatcacgatgcccatgccgagggcagagcgtaatagcatgagttttcggcctttacggtcggcgagtccaccccaaaacggtgaggcgatggccgaaaataaaaatgtaatgctgaagacaataccggaccacatattcagggcggagtgaccggtaacgccaagctgctcaacgtagaggggtaagaagggcattaccagactgaaggcggcaccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggatttgctgtggtaatgccggatgccattctgaagcatccggcatgggagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagtggcggagaacactctggcggcagcataatcaattgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcgataaacgccaatacccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgactaaccaaagtacgccaatacccaaccaggttaaccaataacgcggatgaagcagtgcggtggagaacttgggtagattcgtcatatcaatcctgtttttcaacctattcgggcaattgtatgtattgtcgcattttttcgcccgcaaccaaaatttgtggctgaagactgggcgaaattgccgcgcttgtaaataacaaataatttttaatgcgcaaatgtagcgtaaaatgtgtggatgttaattatcgataattgctatatcatgccgcggatttttactttcccatctcgcaggaaccgtacaccatgccagtgttacacaaccgcatttccaacgacgcgctaaaagccaaaatgttggctgagagcgaaccgcgaaccaccatttcgttttacaagtatttccacatcgccgatcctaaggcgacccgtgacgctttatatcagctgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgcatgaaggtacgcgatcgcattgttgccgacggtattgacgatcctcactttgatgccagcaatgttggtgagtatctgcaagcggcggaagtgaacgccatgcttgacgatcccgatgcactatttatcgacatgcgtaaccactatgagtatgaagtggggcactttgaaaacgcgctcgaaattccggcagataccttccgtgagcagctgccaaaagcagtcgagatgatgcaggcacataaagataaaaaaatcgtcatgtactgcaccggcggcattcgttgtgaaaaggccagtgcctggatgaaacataacggattcaacaaagtctggcatatcgagggcggaattattgaatacgcccgtaaggcgcgcgagcagggcttgccggtgcgttttattggcaaaaattttgtttttgacgagcggatgggcgaacgtatatcggatgagattatcgcgcattgccaccagtgcggcgcgccgtgcgacagccataccaactgtaaaaatgatggctgccacctgctgtttattcagtgtccagtatgcgcggaaaaatacaaaggttgttgtagtgagatttgctgcgaagaaagcgcgttaccgccagaagaacagcgacgccgtcgggcaggacgtgaaaatggcaataagatctttaataagtctcgtggacgtctgaatacaacactgtgcattcctgatccaacagaataaatatcattgccggatgcgtgccatccggcaacatttcacgcttacttctgctgtacgccttccactgaaataatcagatccacttcctgagaagctggacctaaatctgtcttgatattgaagtccttgagcttaattttgccttcggcctcgaagcctgcacgtttaccaccccatgggtcgtcgccctgaccaattaatttcgcttccagcgtgacgggtttggttacgccattcagcgtcagatcgccggtaatatccagttcgtcaccgtctttcttcacgctggtggaggtgaatgttgcctgtggatattttgcggtattgaggaaatctgcactgcgaagatgtttatcgcgttcggcgtgattagtatcgacgctggtggtgttaattgtcacattcactttatcggcagccggatttttttcgtcaaaggtaaaagtaccgtcgaaatctttaaaggtgccgtataaccagctatagccaaggtgctggatgcggaaattaacaaaggcgtgctgaccttctttgtcaattttgtaatcggcggcaaccgctgaaccggcagagaacatcagggacgcgaaggttaaaccaagcaggctttttttcattttttatactccatagtcagatgacgactttcccagcatgcgcttcagagtgtcgtctttatcgatgaaatgatgcttcagggccataaatccgtgcataacggacagtactacgacgctccacgcgagccaaaaatgcagggcaccggcaaagtctgcctgtgcgccagcgtcggcaagggtcgcggggacgtcaaaccagccaaaaacgctgatcggtttaccatcggcagttgagatcagatagccgctgatgccgatggcgaaaagcaataggtacaatgcgagatgtccagctcttgcggcaagacgagtcatgggcgaataactcggcagcggacccggcggtggagatatgacacgccacagaacgcgaataaccagccccatcattaacaaaataccgatgcttttatgcagttcgggtgctttgtgataccagccatcgtaataactgagcgtgaccatccacagacctaaagcaaacatgccgtagacaataattgcgcttagccaatggaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttttatttcaataattttgaattaataatgaaagaatcttcataagtttagtgggttcagcatcagagatgtctggtgagtgctgtagaagcaggaataatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagccgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaatacattgcgcaagaacgggaaggcttctgacccatcactggccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcggccatcggcctgataccaggcaaatactttgcgtacgggctggacaggcagctccgggagcaggtcttttacccatgttcccgcgcagacaatcgcttttttcgcctgatactcaccgtcagccgtttcaatagttacgccatcatcgtcatgacgaattgcggtgaccgggcagttgaacagttgcgcacagcccgcttccttcgccagttggatccaggttttaatcgccagttcgctgcgcaaaaaaccggaatcagtttcaaataagccgatgtagttgtccgggacgcgtatttccggccagcgggccataatcccttgcgcatcgagcttttcaacgttgagttgccattgttcggcgctgtgggcgacgttggcgagaaatgtggaatcagccgggccaaggttaatgacgccagagcgtacaaaaatgggatcttcttcgttgtggcgggagagttcatcccacagcgtttgcgcgcggaggaccagcgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaagggggaaacagataaatttctgcttttaagatttatatgaacaataaaacagcatgtcattcatatttttttagcatattgtgcaattattttgaggaagtgtagaaattttgtactcaaaattcgtaagtaaaataaaaaagccggggcgacccggcaaaaaaaatcactgcatattattcgctgacaaaccagtcatcggcgctttcccacgtttcctggagaatttcactaatgcgctgtttatcttcttttgtcgcgccaataaccgataaattattcgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttccccggcgaggaatggcaccagcgtgtcatcagtcagtgcgatgctttcagcaacctgttgctcttcacgtaccagttcgatgaatgtgtcgttgaccggcaacccatagaactgcgggccgtttacagaacagaatgcttcaaagtgctgcaaagcattcatttcttcaaagacggtagcgtaactgcccagcgcggttggggcgttgaagcagcccgcgcagccgcaactgctctctttgcgatgacgtgcatgtggcgcagaatccgtaccgaggaatactcgattaaaaccgctggcgaccagttcacgcaatgcctgttggtgaatattacgtttgaggatgggtagacaatacaggtgcggacgcacgcctccaaccagcatatggttgcggttaaacatcagatgctgcggagtgatggtggcagccagccgttcatttccgtcacggacatagtcggcagcatctttggtggtgatgtgctcaaaaacgactttcagcgcagtcaggcgctggcgcagaggttccatcacgctttctataaagcgcgcttcacgatcaaaaatgtcgatatctgcatgtgtcacttcaccatgcaccagtagcggcataccgattttttccatgcgctcaagtaccggcatgattgcgtcaattgacgtcacgccgtggctggagttagtggttgcgtttgccgggtaaagttttgcagcggtgaacacgccttcgttaaatccgcgctccagctcattaggatccagcgaatctgttaaataacaggtcatcaatggggtgaaatcgtgcccggcaggtacggcgtcaagaatacgctggcgatacgccacggcagcctcaacggtggtcacgggcggagccagattgggcattacgatagcccgtccataaatttcgctggtatatggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaatggaatgacaatttcgcctggcttcacttcaatgcctttcgccagttttttcgccattgcttcgccctggctgccatcttcgcgcaggacgtaagcaggttgctggttaaagtaattgcgtaatgcctggttcaaatagggaagcaacgtttgcatcaccgtttgcattttttccggttgtaccgtcgcatcgaccacttccatctctttcaggaagatcgcacctttttctttatcaaacacgggcagcgctttcagcttcagtttcatggtcgctttctgactaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaactcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttaattccggctaccagcgtcagattacgcagtagcgggaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcgggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatgaaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtccgccagcgaagcacttaaggtttcacgcgcaggctcggcaatgatcgacccgatataaaacagacaaatcagggtgaaaagttgttgcaggccgctgaccatgcccaccggcatcatgcttaatgacattatcaacagcccagccatcaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcagaacataggtgacaaaacgcttgtcacgcatcacgcgggtcatgccttcgcgaacgggcgtgcgtacggtggagagtttccatgctggtaacaaccacgcattgaacgccgcacatagcacaaatagaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggcggatcaaacaacgtgccaccgagtcccgagagcaggcatgaaaaccacaatagccacggttcgtgggcgatacccattgtggcgaatccggcggcgcgcatcagcataccggtaacaatcatcggtttggcaccaaagcggtcggcaattgcaccgccgaaaatacccagaccttgctgaataaattggcgtagaccgagagcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattttggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagctttctactttggcttattcgacccggacgaaaaagagattattggcgttgccaatttttccaatgttgttcgtggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgcccttgaagctcgcgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaagtgcaggaacagctggataatctggtcaaacgtcattatctacgcacagtgagcggttttggtaatcgggtcaccaaatatgagcaacgtttttgtaattcagaatttggcgatctgaaactgagcgcagcggaagtggcgttaatcaccacgttgttattgcgtggtgcccagacgccaggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgcgaaaaccgctacatgcatcttttcagtggtgaggttgaagatcagccggcggtgacggatatgtcgaacgcggttgacggtgatttacaggcccgcgtcgaagccctggaaatcgaagtggcagaactgaaacagcgtcttgattcgttgctggcccatctgggagattaaagtgaaaaaattacgtatcggcgtagtgggattaggtggcattgcgcaaaaagcgtggttaccggtgctggcggcagcgtctgactggacgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggctggtcctttgcagatcaccacctgtatgcatcgccgtgccggaagtcagcgtgaaaccgtgcaggccgtgactgacggtgcgctcatcgacattacggatatgcgcgaatggcgtgaggagcgcgggcagggcgtagtgcataaaccgattcctggttggcagagtacgcttgagcaacgtgggtttgtcggctgtgcgcggcacttcattgaatgtgtgcaaaaccagacagttccgcaaaccgccggcgaacaggccgtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgagacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcgatccttggcgtctctgtgagccagatctccttaatcatcaacaccatttttgcctcgtttcttgcttccggttcggtgtcttggatgtattacgccgaccgcttaatggagtttccgtccggtgtgctgggcgtggcgcttggcaccattttgctgccgtcgctgtcgaaaagttttgccagtggcaatcatgatgaatacaaccgtttgatggactgggggttgcgtctttgtttcctgttggcgctgccgagtgcggttgcgttgggcattctttccggtccgttgaccgtttcgctgttccagtacggtaaatttaccgcgtttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacccggctggatggcgtttctgttgcgtctggtggtggcggtactggtgatgtctggcgtgcttttaggtatgttacatatcatgccggagtggtcattgggtaccatgccctggcgtttactgcgtttaatggcggtcgtgctggcggggattgccgcgtacttcgctgcactggcggtactgggcttcaaagttaaagaatttgcccgccggacggtgtaacaatgcattccggcctgcagtgcaggccggagataatcttcagatcgaaatctttttaccgccgcgatgggttgttgaggtctgaccgttcgccccatatagcgtcggttcctgatgcggtttcaacatttccagcgcctgttgattgcgctcaatctgtccttccagtaaccagccgttatgttgattcatttggcgtagttgctgcgttttcacagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgtgtcatacgatcagttactctgcaagtcttgctgcgcttcgttgatcagcgcatcggcaattttgccggtgtccatttttagttcaccgttacgaatcgccagttttaacgcttcgacacgttcaagattgatatcactgctgccgggttgcatcagttttgcttgcgcgtcgcttaacgtcacactggtgctggtggaggcggttgtttttgccgcccggctgttcgttaccggcgcgtcagtggtttcgcgcggttgaacggtgcttacaggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgactacctgtcccgataccatgcgcacccgcgcattctgtgcgacggctgcattgttcagcgcctgaccttctgcgttggcgctaaacccatcaccgctggcgatcacattgacgcgttgtcccgcttttacccgccatgcctggcgaaactgggttaactggataggttgatcgggtgatagatcgcgcaggctaatggcatcaacaagttgattgatatccagcaccgtacgcggtggcagggtatccagccgtccgcgtttcagtttgacattgccagcttccagctttcctccccgcgcaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcatggcggtagtagattgggcgctgtacgaatagaaacacgaacctcatcacttacccccgcgagttgggcgctaaaaaagttgtgcaattgcgatgtgagattgctcgccgtacttaacggactgaacagtatcgcgatgatcgccacgctacgttttattatcagcattttcgcccccagccatttctacaacgtgaattgtacctgtccgcaatgaccatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggcgcgcgatatcgattttgccagtgaacttaaaaaagtcatgcaacgtggacgggatgcaaccagtgtggttgcactgacgatgacctcaacgcaacacattccggcgcaggcgctgacgcctcctaccgcagaactgcaataccgtattccggaccagccttcgcttgacggtaataccgtcgatatggatcgcgaacgcacccagtttgccgataacagcctgcaataccagatgagccttagcgcgttgagcgggcaaatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtgaccggtcccgatggacagccatatcgggcaaaacaggtggtattccaggttaacgctgcaccaggtgctgcgacaggcggcgtaaaggttgccgatgttatagaaagtcaggccccggacaaactggtttatgaaccgggtaatccgctggcagatgcaaagggctacgtaaaaatgccgaacgttgatgttgtcggagagatggttaacaccatgtcggcgtcacgcagctatcaggccaatgttgaagtgctcaacacggtgaaaagcatgatgctgaaaacccttacgctcggtcaataaaggagaaagctatgtccattgcggtaaccaccaccgatccgacaaataccggcgtcagtaccaccagcagtagttcgctcacgggcagcaacgccgcagatttacaaagcagttttctgactttgctggtggcgcagctgaaaaaccaggacccgaccaatccaatggaaaacaacgagctgacgtcgcaattggcacaaatcagcacggtcagcgggattgaaaaactcaataccacgctcggatctatttccggacagattgataacagccagtcgttacaggccagtaacctgatcggtcacggcgtgatgatccccggcaccactgttcttgcgggaaccggcagtgaagaaggggctgtgaccacgaccacgccgtttggtgttgagctgcaacaggcggcagacaaagttacggccaccatcaccgataaaaatggcgcggttgtgcgcaccattgatattggtgaactgaccgccggagttcacagtttcacctgggacggtacgttgactgatggcagcactgcgccgaacggttcttacaatgtagcgattagcgccagtaacggtggtacacaactggttgcccagccgctgcagtttgctctggtgcagggtgtgatccgcggcaacagcggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcactcaggactttaccgatggcacgaccaccaacaccgggcgaggtctggacgttgctatcagccagaacggttttttccgtctggtagacagcaacggttcggtgttctacagccgtaacggacaatttaagctggatgaaaaccgtaacctggtgaatatgcaaggtttacagctgacgggttacccggcaaccggtacgccgccgactattcagcaaggggcgaatccgaccaatatttcgatcccgaataccctgatggcagcgaaaactaccaccacggcatcgatgcagatcaacctgaattccagtgatccgcttcctactgttacgccattcagcgccagcaatgcggatagctataacaaaaaaggttcggtgactgttttcgacagtcagggtaatgctcatgacatgagcgtctactttgtgaagaccggggataataactggcaggtctacacccaggatagcagtgatccaaacagcattgcgaagacagcgacaacactggaatttaatgctaatggcacattagtggatggtgcgatggcgaataatatcgcaaccggcgcaattaacggtgcagaacccgccacgtttagtctgagcttcctcaactccatgcagcaaaataccggcgctaacaatattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtctgcgacgcaatcttctggcgtggcgctgttggggacagccgggacgggaaactttggcaccctgaccaacggtgcgctggaagcgtccaacgtcgatctcagtaaagaactggtcaatatgatcgttgcccagcgtaactatcagtctaacgcccagaccatcaaaacccaggaccagatcctcaacacgctggttaacttacgctaatcgctgacgggatagctcaatggatcacgcaatttataccgcgatgggagcagccagccagacactgaatcaacaggcggtaaccgccagtaatctggccaatgcctcaacgcccggttttcgcgcgcagttgaatgctttacgcgcggtgccagtggaagggctttctctgcccacgcgcacgttggtcacggcgtcaacgccgggcgcagatatgacgcccggcaaaatggattacacctcgcgcccgctggacgtcgcgttgcagcaggatggctggctggccgtgcagaccgctgacggcagcgaagggtatacgcgtaatggcagcattcaggttgatcccaccgggcaactgacaattcaggggcatccggtgataggcgaggctgggccaattgctgtgccggaaggggcggaaatcactattgctgccgatggcacaatctcggcgctcaatccgggcgatccggcaaatacggttgcgccagtagggcgtcttaaactggtgaaagccacgggcagcgaagtgcagcgcggtgacgacggcatttttcgtttaagcgcagaaacccaggccacgcgtgggccggtactgcaggcagatccaaccttgcgtgtgatgtcgggggttctggaaggcagtaacgtcaatgccgttgcggcaatgagcgacatgattgccagcgcgcggcgttttgaaatgcagatgaaggtgatcagcagcgtcgatgataacgcaggccgtgccaaccaactgctgtcgatgagttaattgaaaggatacatgacaagtataagttgcccgatgcgcaagtttatcgggtctatgggggcaatcgcaatttatcgattttgcgagcacttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgtcagtactaacggttttaagcgtcagcgcgcggtgtttgaagatctgctttatcaaaccattcgccagccgggggcacagtcttccgaacaaaccaccttaccctccggattacaaatcggcacgggggtacgcccggtcgccactgaacgcttacacagccagggaaacctgtcgcagaccaacaacagcaaagatgtcgcgattaaagggcagggctttttccaggtgatgttgccagatggttcatcagcctatacccgtgacggctctttccaggtggatcagaacgggcagctggtgacggctggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccgggctggagagcattggcgaaaacctctacaccgaaacgcaatcctctggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtgcagggggcgaccagtgcacaaccggttcccggtccgacgcccgtcgccaacggttctattttccagtctgctcagccgattaactatggctatcaaccgctgtttgaagatcgtcgaccacgcaatattggcgatacgctgaccatcgtgttgcaggagaacgtcagcgccagcaaaagctcctctgcgaatgccagccgtgacggtaaaactaattttggctttgatactgtgccgcgctatttgcaggggctgtttggtaacgctcgtgccgatgtcgaagcctccggtggtaacacgttcaacggaaagggcggggccaatgccagcaatacctttagcggcacgttgacggtgacggttgaccaggtactggtcaacggcaacctgcatgtggtgggtgaaaaacagattgccattaatcagggtaccgaatttattcgcttctctggcgtggttaatccacgcactatcagcggcagcaataccgtaccgtctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggtcacgacggcggctcaggctgagcgtattcgcgatctcaccagtgttcagggggtaaggcaaaactcactgattggctatggtctggtggtggggctggatggcaccggtgaccagacaacccagacgccgtttaccacacaaacgcttaataacatgctctcacagctgggaattaccgttccgacgggcaccaatatgcagctaaaaaacgtcgctgcggtaatggtgacagcgtcacttcctccgtttggacgtcaggggcaaaccatcgatgtggtggtttcttccatgggaaatgccaaaagcttgcgtggaggtacgttgttgatgacaccgcttaagggcgttgacagtcaggtgtatgcgctggcgcagggcaatattctggttggcggcgcaggagcctccgctggcggtagcagtgttcaggttaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccgagtggcaacagttcccaggtccgcttccttgccgatattcagaatatgcaggttaatgtcaccccgcaggacgctaaagtagtgattaactcgcgcaccggttcggtggtgatgaatcgcgaagtgaccctcgacagctgcgcggtagcgcaggggaatctctcagtaacagttaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtccatactgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccggcggcaaatatccgtccggtggcccgtcaggtggaagggatgttcgtgcagatgatgttgaaaagcatgcgcgacgctttaccaaaagatggcctgttcagcagcgagcacactcgcctgtataccagtatgtatgaccagcagattgcccaacagatgacggcgggcaaaggtctggggcttgcagagatgatggttaaacagatgacgccagaacaaccattgccagaggagtccacgccagcagcaccgatgaaattcccgctcgaaactgtggtgcgttatcaaaatcaggcgctttcgcagctggtgcaaaaggccgtgccacgtaactacgatgattcgctgccgggtgacagtaaagcattcctcgcgcaactctcgctgcccgcccaactggcaagccagcaaagcggtgtgccacatcatttgatcctcgctcaggcggcactggaatctggttgggggcaacggcaaatccgccgcgaaaacggcgagccgagctataacctgtttggtgtcaaagcctctggcaactggaaagggccagttactgaaatcaccacgactgaatatgaaaacggcgaagcgaagaaagtaaaagcgaagtttcgcgtctacagctcgtatctggaagccttgtcggattacgttgggctgttaacgcgtaacccgcgctacgccgccgtgacgaccgccgcgagtgcggaacagggggcgcaggccctacaggacgcgggctatgccaccgatcctcactatgcccgcaaactcaccaacatgattcagcagatgaaatcgataagcgacaaggtgagcaaaacctacagtatgaacattgataatctgttctgaataactcaagtccggcgggtcgctgccgataatactctgtaattgaaggcttataaggaacctccatgtccagcttgattaataacgccatgagcggactgaacgcggcccaggcggcgttaaatacggcaagtaataatatctccagctataacgttgccggatatacccgccaaaccactattatggcgcaggccaatagcacgttgggcgctggcggctgggttggcaatggtgtctacgtttctggtgtgcagcgtgagtatgatgcgtttattaccaaccagttacgtgcggcgcagacgcaaagtagcggtctgactgcccgctatgagcagatgtcgaaaatcgacaatatgctctccaccagtacctcttcgctggcaacacagatgcaggatttcttcaccagcctgcaaacgctggtgagtaacgcggaagacccggcagcgcgccaggcgctgattgggaaatcagaaggattggtgaatcagtttaaaaccaccgatcaatatctgcgcgaccaggacaaacaggtcaatatcgcgataggtgccagcgttgatcagatcaacaactacgctaaacaaattgccagcctgaacgatcaaatctcgcgcctgacaggcgtgggggcaggggcgtcacctaacaatctgctggatcaacgcgatcaactggtgagcgaattaaaccagattgttggtgtagaagtcagcgttcaggatggcggcacttataacatcacgatggccaatggttactcactggttcagggaagtacggcgcggcaactggcggcagttccttccagcgctgacccttctcgtacgactgtcgcttatgttgatgggacggcaggcaatattgagatcccggagaaattactgaataccgggtcgctgggcggcattctgacattccgttctcaggatctggaccagacgcgtaatacgcttggacaactggcgctggcatttgccgaggctttcaacacccaacacaaagccggatttgatgctaacggcgatgccggtgaagatttctttgctatcggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatctgcaaagcaacagtaaaacggtgggcggtgcgaaatcctttaacgacgcttatgcctcgttagtgagtgatatcggtaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataagatgcgtttcagtacacagatgatgtaccagcaaaacatgcgtggtatcaccaattctcaggcagaatggatgaagtacggcgaacagatgtcgacgggtaagcgagtcgttaacccttctgacgatcccattgctgcatcacaagccgtagttctctcccaggcacaggcgcaaaacagccagtacacgctggcgcgtactttcgccactcaaaaagtgtcactggaagagagtgtacttagccaggtcaccactgctatccagaatgctcaggaaaaaattgtctacgccagcaatggcaccttgagtgacgatgaccgggcctcgctggctacggatattcaggggcttcgtgaccagttgctgaatctggcaaacaccactgacggtaacgggcgctacatttttgccggttataaaacagagactgcgccgtttagcgaagagaaagggaaatacgtcggtggagcagaaagtattaaacaacaggtcgatgcttcgcgttcgatggtgatagggcacacgggtgacaaaattttcgacagtattaccagcaacgcggtagcggaaccagacggtagcgcttctgaaaccaatctttttgccatgctggatagtgccatcgcagccctgaaaacgccggtcgcggatagcgaagcggataaagaaaccgccgctgcggcgttagataaaaccaaccgcggactgaaaaactcgctgaacaatgtgctgactgttcgcgcggaattaggcacgcagctgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcagcaaataatttcgctttaaaacatatcatgaaactgggtatgttttgtctgcctgctctgggatcgctggggcgggcatttttttgcctattttgcattgttggttagcaaggatgccattcgatgaattttaatatgttgattcaaagatgaaataaaaaagccctggcagttaccagggcttgattactttgagctaattattactcaacaggttgcggacgcgcaggagcggcagaggcatgatgtgttgccgtatgaccacctgcggcacctttaccttcgaaggcaaaagtagggcgctgccagtcactgtgacgcggtgcctccggaacatattccggtgctggagcgcgcgtcattggcgcggtagcgtggttatgctcaacggtgacctcaggttcgaccgcagctaccgtttcaacttctgctgcgacttcagcgactactggcgcggcaggttgagcaacaacttcaggttcagcaactacaacctcagcagtttcgacaacttcttcaatatctgccgtctcttcctgcggttcaaccaccggttctgcttgttctgcaacttcctgggctacggcaacatcagactcggtaatcacctgcggctgttcagttaccgcggcagcgatcacttcaggatgcgtcgtttcaaccacttccggttgcggttcggcaacctgaacgggggcttctacgacaccggccacttcttcaacaactggcgcgctaacaaccggttcgatagcggcggcgacagggacctcagtcaccatcggctgcacatgtacttcttcctgttcgcgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcagcattgttctcttcttgctgttctggtgcagtttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcattacggcggcggctacgttcacgacgcggcgcttgctgctcgtcggcggtacgcgctttttccgttacctcagcctgctgacggctctcacgcgtctcggcagtctgctgctgtgcctggcgacgattacgacggttttcttcgcgattatcgctgccttcagtacgttcactacgggtgtcgcggcgctcattacggtcacggcggttgttctgacgaggcttgcgacgatcctgttgacgttccggtttcgcttctgctttcggtgctggttgctcggtcggtttggtttcttcaccaccgctgaacagcgctttcagtgcgccgaagaagcggctcaacagcccaggttgtgcaggagctgctggtgttgccggtgcagctttcggtgctggagctacaacaggcgcggcaggttcagctggcgttggcgcaggcggcacatccggcatggcaaaggttgccagcgcaggttgttccggacgcttacgttcagcgaactcttcttcagacggcagcgccatcgcttcttcatgcagcttcggcagcatgtagcttaaggttggggtttcttcccctttacgcacgcgcagcacgtggtagtgcggggtttccatctgatcgtttggcacaattacacagcgcacaccgtcctgacgagtttcaatggcatttaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtgccagtaccagaacaacgcggacaaacgtgatgactggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtactggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatggaaccaccagacggcagacgaacttcacgctggaaggcggactcgatctgtgactcgatctggtagtggctgaacagcgggatctcgccggtgtacagtttgattttgctgctgaaatccgggcgacctaatgcagcgatatgctgacgtgccagttcgagcactttcgggttatcgataaggatttcgccgatgtcctgacgtaagtaatcgcggaatgcgcgaacgattacgttgctctcctgatgaatcaggaacggggccgggcggctttcagcggcttttttgatggcttcccagtgtttcagacggaagcttaaatcccattgcagcgcctcagcagatttgccgacgccagcggtgcgcacgataagccccatgccttccggcagttcaaggcttgccagtgcttcttttaattcggtacggtcgtcgccttcgatacggcgagaaatgccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagtgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattcttacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcaaagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacgcagtgaagtaataaggtgcaaaagtaaatataagcatagaaaaatgagtggcgcgaatcctgttggctaattagaatcgccaaccatgaaaacagagactccatccgtaaaaattgttgctatcaccgctgacgaagcggggcaacgtatcgataactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtattccaccggttcgcgttgctgagcgggaagaagaggcggtttcgccacatctgcaaaaggtggcggcgctggcggacgtcatcttatatgaagatgatcacatcctggtgctgaataaaccttccggtacggcggtacatggcggcagtggtttaagcttcggcgttattgaaggtttgcgggcgttgcgcccggaagcgcggttccttgaactggttcatcgtcttgaccgggacacctcaggtgttttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcaccgttactgaaaaatattctgcaaagcggcgaacgtatcgtgcgtgtgagtcaggaaggcaaaccgtcggaaacacgctttaaagtggaagaacgctatgcatttgccaccctggtgcgttgtagcccggtaacagggcgtactcaccagatccgtgtgcatacacaatatgcgggtcatccgattgcctttgacgatcgctacggtgaccgtgaatttgacaggcagctcactgaagcaggcacgggattaaatcgcctgttcctgcacgctgcagcgttgaagtttactcatccggggaccggtgaggtgatgcgtatcgaagctccgatggatgaaggtttgaagcgttgtttgcaaaagctgcgtaacgcgcgctaatacaagcatataaacctgataatgggcggttggcctgataaggcgtttacgccgcatcaggccgccagcaccgattgccggatgcgacgtaaccacatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgcagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggggtttcgtcgacctctggtgctgcacattcaaaagagatttgcagtttttccagaagagcgcgacgccatggcgaggtggaggctaaaataagtttaggcatatttttttccatcagatatagcgtattgatgatagccattttaaactatgcgcttcgttttgcaggttgatgtttgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatacccctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcatctgcgtgatgaagcttagtgaggattttccccaggcaactggggaaagaccaaaccgggcggcgacgataccttgacacgtctaaccctggcgttagatgtcatgggaggggattttggcccttccgtgacagtgcctgcagcattgcaggcactgaattctaattcgcaactcactcttcttttagtcggcaattccgacgccatcacgccattacttgctaaagctgactttgaacaacgttcgcgtctgcagattattcctgcgcagtcagttatcgccagtgatgcccggccttcgcaagctatccgcgccagtcgtgggagttcaatgcgcgtggccctggagctggtgaaagaaggtcgagcgcaagcctgtgtcagtgccggtaataccggggcgctgatggggctggcaaaattattactcaagcccctggaggggattgagcgtccggcgctggtgacggtattaccacatcagcaaaagggcaaaacggtggtccttgacttaggggccaacgtcgattgtgacagcacaatgctggtgcaatttgccattatgggctcagttctggctgaagaggtggtggaaattcccaatcctcgcgtggcgttgctcaatattggtgaagaagaagtaaagggtctcgacagtattcgggatgcctcagcggtgcttaaaacaatcccttctatcaattatatcggctatcttgaagccaatgagttgttaactggcaagacagatgtgctggtttgtgacggctttacaggaaatgtcacattaaagacgatggaaggtgttgtcaggatgttcctttctctgctgaaatctcagggtgaagggaaaaaacggtcgtggtggctactgttattaaagcgttggctacaaaagagcctgacgaggcgattcagtcacctcaaccccgaccagtataacggcgcctgtctgttaggattgcgcggcacggtgataaaaagtcatggtgcagccaatcagcgagcttttgcggtcgcgattgaacaggcagtgcaggcggtgcagcgacaagttcctcagcgaattgccgctcgcctggaatctgtatacccagctggttttgagctgctggacggtggcaaaagcggaactctgcggtagcaggacgctgccagcgaactcgcagtttgcaagtgacggtatataaccgaaaagtgactgagcgtacatgtatacgaagattattggtactggcagctatctgcccgaacaagtgcggacaaacgccgatttggaaaaaatggtggacacctctgacgagtggattgtcactcgtaccggtatccgcgaacgccacattgccgcgccaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatttccacccatctgcatgccgacggtagttatggtgaattgctgacgctgccaaacgccgaccgcgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggtatgtctatggataatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctaggataaggattaaaacatgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaactcagcctgcgctgttgactgcatctgttgcgctgtatcgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagcggcgggcgcaaaacgcgcgctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaaaagaggaaaatcatgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctgaccgcgatttgcacaaaatgctcatgttgcgcgcagtctgcgtggttatgagtaataattagtgcaaaatgatttgcgttattggggggtaaggcctcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtgctgaaagtcgtgatcagtcgcggtagtggcgggcgagggtacagcacattgaacagcggaccggcaacgcggattctctccgttacggcttatcctgcacattacgaccgtttgcgtaacgaggggattacgttggcgctaagcccggtgcggctggggcgcaatcctcatcttgcaggtattaaacatctcaatcgtcttgagcaagtattgattcgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagagtcgttgcaggcagatgagatggttatttgtaatgcgttaatgccagtgatgcccgtatgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttaccctgaagccagggaccggacgtctggcgctcggtgaacagctttatgccgataagatcatcaatcgtccacgggtttttcaatggctgctgcgtatcgaaccggatctttctcactttaaagccgggacttaccgctttacaccgcagatgaccgtgcgcgagatgctgaaattgctggaaagcggtaaagaagcacagttccctctgcgactggtagaagggatgcgtctgagcgattacctcaagcaattgcgtgaggccccgtatatcaagcatacgctgagcgatgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgataaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaaccagctctggctaacggcacctgggtgattggcgatcgccacgatctctccactcaggcgtatcagggcggcggacgtggtattgaccaacatatgctggcaacactgcgtgatgctgttctcggggattttcgccccgacttaacgctctatctcgatgttaccccggaagttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacgcatcccgattactacaccctggctcccgaaaaaggaaaaaatacgctgggcgttgatgcggtacgtgaggtcaccgaaaagctgaatgagcacgcacgcttaggtggtgcgaaagtcgtttgggtaaccgatgctgccttactaaccgacgccgcggctaacgcattgctgaaaacgcttgaagagccaccagcagaaacttggtttttcctggctacccgcgagcctgaacgtttactggcaacattacgtagtcgttgtcggttacattaccttgcgccgccgccggaacagtacgccgtgacctggctttcacgcgaagtgacaatgtcacaggatgcattacttgccgcattgcgcttaagcgccggttcgcctggcgcggcactggcgttgtttcagggagataactggcaggctcgtgaaacattgtgtcaggcgttggcatatagcgtgccatcgggcgactggtattcgctgctagcggcccttaatcatgaacaagctccggcgcgtttacactggctggcaacgttgctgatggatgcgctaaaacgccatcatggtgctgcgcaggtgaccaatgttgatgtgccgggcctggtcgccgaactggcaaaccatctttctccctcgcgcctgcaggctatactgggggatgtttgccacattcgtgaacagttaatgtctgttacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacatatgcgggatctggtaggcgaacgtgacaacgtcgtattttcttgtggcgtgcatccactcaaccagaatgatccctacgatgtagaagatttacgccgtctggcggcagaagagggtgttgtagcgctgggtgaaaccgggctggattattattacacgccggaaactaaagtacgtcagcaagagtccttcatccatcatatccagattggtcgtgaactgaacaagccggttatcgtccatacccgtgacgcccgtgccgatacgctggcaattctgcgcgaagaaaaagtgacggattgcggtggcgtactacactgttttacagaggacagagaaacggcgggtaaattactggatctcggattttacatctccttttccggcattgtgaccttccgtaatgcggagcaactgcgcgatgctgcgcgttatgtccccctggatcggttactggtggaaactgactcaccttaccttgcgccggtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaattgggcggtgaataaccacgtttgaaatattgtgacatatgttttgtcaaaatgtgcaacttctccaatgatctgaagttgaaacgtgatagccgtcaaacaaattggcactgaattattttactctgtgtaataaataaagggcgcttagatgccctgtacacggcgaggctctccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggagggattatctccggtgcgatcgcagcgtacatgtttaaccgtttctaccgtattaagctgcctgagtatcttggcttctttgccggtaaacgctttgtgccgatcatttctggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgcgattgtttactacaccatcttccgcgtgctgattaaagcactggatctgaaaacgccgggtcgtgaagacgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggccggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgtgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggcgtcacggtgtcggtatacacgcgattttgccagttaacaccaccgccgaccgtcaactctggcatgacaggcaaccgatagctggtgaacattttaaccgtggtgcgtggcagattaggattaacggcgtttccttcgttatcctctgcaatatagcgcgttgcgccaaatgtcagctgccagttgtcggtaattgcgccgttgagttcaaattccacccctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagccagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccactgttccaaccggtgccgccgacataatcaaagccaggtccataattactgtatggcccaaccagcataccatccgctttgtttacataggcatcgacatacatcattttgctgtcaaattcgacttcagagtgggtggcattcagtgtcgcttgccaggtatcagcaaactgctgcttcagggtcataaagaccttgttgatctctttatcgttgtacgcccagtcaggtgcggtactgcgtgcgcgatcgtaactgttgctgctgccatcagtattccagcgcggtaaaccgccccaggtagggctattaacatcaatgcgctgatattcgtaaccggctgaaagcgtcgtaagatcgcctaaatcagcatcgacaatgcccgagaagaaggtcttttcactgttgtagcggtccagccatgagtcgttattctggtagccgccgacaattcgcgcgcggattttaccgtcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgagtcctgtcgcgccacgcactacttctacgcgttcaaagagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcattttggtacccgcagaggtagacgttacgctgtaatcattttcgccatcatctggagctgtggctgaaccctcaacaatcaccgtttcttcagtggctggtgcagcaaaagcggcagaaggtaatagtgccagtgctatgcaaccggcaagtagtgacggtttggtgatggcttgatattgattatccctgttaaattgtgttgaaagcatttgaaatctcttggtttatgttgtcgtcaggctcatgccggaggagggtgatgagcgattatatttagtgtgcgaataattttgtttgtaaatgcaaatgagaaatatacgcattcatatttgtcatgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtctcagctgagcatgagcaggcgctgggacgcatgatcaccgtagcggcaaaaattgctgagcaagaaggtattgccgaagatggctatcgtctgatcatgaataccaaccgccatggcggacaagaggtttaccacatccatatgcacttgttgggtggccgtccgctgggaccaatgctggcgcataaaggtctgtaacgatgagaaaaggatgctttgggctggtgtctctggtgttgttactgctggtgggctgtcgttcacatccggaaattccggtgaatgatgagcaatcgctggtgatggagtcatctttattggctgcgggcatcagtgcagaaaagcccttcctttcgacgtctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtaacgctgtacggcagcgccaattttctgggggcgcacaaagtcagactttatctatatttgtaaggggtgaatcttgatgacaaaaatgagtcgctacgccttgattaccgcgctggcgatgtttctcgccgggtgtgtggggcaacgtgaacctgcaccggtagaagaagtgaaaccagcgccggaacaaccagccgagccacaacagcctgtccccacagtgccctcggtgccgacgatcccgcagcagccaggcccaattgagcacgaagatcaaactgcaccgcctgcgccgcatattcgccattatgactggaatggcgcaatgcagccgatggtcagtaagatgcttggggctgacggggtgactgcgggtagcgtcctgctggttgatagcgttaacaaccgtactaacggttcgctgaatgccgcagaagcgaccgaaacgctgcgaaatgcgctggctaataacgggaaatttaccctggtttccgcccagcaactgtcgatggcgaagcaacagttaggtttgtcgccgcaggacagtttaggcacccgtagtaaagccataggcattgcccgcaatgtcggcgctcattacgtgctgtactccagcgcctctggcaacgttaacgctccgaccctacaaatgcagctgatgctggtgcagacgggcgaaattatctggtcaggtaaaggtgccgtttcgcagcaataatcccatcacgcgcgacgaattgctgtcgcgctttttcccgcagtatcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtagtcgactatctgcccggcgcggtaaaaacgtatttgccggataccaacgaactggcaggcttgctgtattatctacatcaacaaccacgttttggctggcgaataacgctgttgccgttactggaactgtactggcagcaaagcgatccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatactgaacagcaccggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaataaaacaataaggagagcagtgtgggtccagtaatgttggatgtcgaaggttacgaactggacgcggaagagcgtgaaatactggcgcatccgctggtgggagggctgattctctttacgcgtaactatcatgatcctgcccagttacgtgaactggtgcgccagatccgcgcagcttcgcgcaatcgtctggtggtggcggttgatcaggaaggtggacgcgtgcagcgttttcgtgaaggttttacccgcttgccagcggcgcaatcattcgctgcgctgtcaggaatggaagagggtggcaaactggcgcaggaggcaggttggttgatggccagcgaaatgatcgctatggatattgatatcagctttgcgcctgtgctggatgtcgggcatatcagcgcggcgattggcgagcgttcttatcatgccgatccacaaaaagccctggcaattgccagccggtttattgatggtatgcatgaagccggaatgaaaacgaccgggaaacacttcccaggacacggtgcagtaacggcagactcacacaaagaaacaccgtgcgatccacgtccacaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaactgggttttgacggcgtgattttctctgacgatttatcgatggaaggtgccgcgattatgggcagttatgccgaacgcgggcaggcttcactggatgcgggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaagcaggtcactaaccctggcttatgtgaggaagcgatgattatctatttacacggttttgactctaacagtccgggtaaccacgagaaagtcttacaattgcagtttattgacccggatgtacgcttgataagctacagtacgcggcatccgaaacatgatatgcagcatctgcttaaagaagtggacaaaatgttgcaactgaacgttgacgagcgtccgctaatttgcggcgttggcttgggcggatactgggcggaacggattggttttctttgcgacatccgccaggtgatcttcaaccctaatttgttcccttatgagaacatggaaggcaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccgaattctgtgggtcggataaggcgtccacgccgcatccgacagtcgagcatcaatgcctgatgcgcttcttatcaggcctaccgaacgccctgcatacacccctcactctatatcactctcacaaattcgctcaaataataaacaataaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaagattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacgccaggtgtcaaagagaactgcattttcctcgataacccgcaccaggcgcgtcgcttccaccaggagatgctgaatttgttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggctgatctgatggtatgggcagccgggatcaaagcgccagacttcctgaaagatatcggtggtcttgaaactaaccgtatcaaccagctggtggtggaaccgacgctgcaaaccacccgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaagccgctgaaaaattatcagtataaagatcatggttcgctggtatcgctgtcgaacttctccaccgtcggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaatcgacgtacactggcggatgtggcataaacgcctcatccgcccttgaggaacagcgcgatcggcagccgcgttgtatcaggcatcctttcagactcctccgaatccttaagtatttccagccattcccgcgcttttcatcttctgtctgatagctgcttttctccttcgcttgcatgattggcataactgcaaagaaggaggtgttcccgtgaataaatcaatgttggcgggtatcgggattggtgtcgcagctgcgctgggcgtagcggcagtggccagtctgaacgtgtttgaacggggcccgcaatacgctcaggttgtttctgcaaccccaatcaaggaaacggttaaaacaccgcgtcaggagtgtcgcaacgtcacagtgacccatcgtcgaccggtgcaggatgaaaatcgcattaccgggtcggtgctcggcgctgttgctggcggcgtgatagggcatcagtttggtggtggtcgcggtaaagatgtcgccactgttgtgggggcgctgggtggtggatatgccggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgcatggaccgcgatccgggtacgcagatcccgctagatagcaacgggcaactgattttgaataacaaagtataacaaggctgtactctgcaatttggcccctcattcgctcaggctgaggggctttttttgcgacttatttcaccagttcgggccataaacgcaaagtcgttccggcaatctgcatcagtttttccagcgatgcaccttcgcgtgcgctgatcgacatcccctgaataatacaattaaggaattctgccagatgtgtcacgtcacagtggggcgggatttccccgcgcgcttgtcgttgacataaaaactgctgcaaagtgcgctcttgcatcgcatggcgtgatttcaacgtattggcgatatctcctgaatctggggagagggtggtgcagttgttgatcatgaagcagcctgccggggtgtctttgctggtaaagcagttggcgatggcagcaaaatagtcagccagcgcagactccacgcttttctcttcacaaaacagctgtgcttcatgcttagcggcaaaacgatcgatatagcggtcgagaacggcacgaaataacccctctttgttggtaaattccgcgtatagcgtgggcgctttggctccggtcgcttcgacgaggtccgcaagagaagtcgcttcataaccgtgttgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagatcccataaaaataattgctttctatttaactgaaatttaaagatttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaccctcatcgctgcggcgattttaagctccatgtcatttgccagctttgcggctgtcgaagttcagtcaacgccagaaggccaacaaaaagtcggtacaatcagtgctaacgcggggacaaatctgggatcgctggaagagcagctggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccagtccagccggcactaccgcaggcaactcaattccctgtgctttataacgggcgcggatgtttgccgttggcgtccaggttgggtttgcacgtttgtctgaaacggtggtcaccattgtcggtgtcagcgtgtcaccacctaactgaccaatacctattggatacacggttaccgaatttttacccggcgggtagtaatagagacgcagctccgcaatgttgatcacaatgccttcgcgcggcgcatctggaagtagggtttgcaacgggatcgttaacacgctgcccgcgcgcggtacgtaaggatcaacgccggggttagcctgtaacagagcgagaaagccgacgttgtattttttggcgatggcttccagagaaccaccgtcattttccaccacatgaaatttgttttcgccaaccagacgactgcccgctggcggcagcggccaggtgttggcttttgccggtagcgccagcgccacggcagcggcgaacgtaaaaaacgttagccagcgagaaaaacgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccccgatttaccattaagcgatcgcgttctcttccagttcacgcataaactggcgtacccattcgatacgcgttttccgctcactcaaatcctgaataaatttcaggcgcgtcggaccatcaaggcggtaatgctgcggctgtttttgcagcaaaccaatcaaccaggccggattaacgtgattcttctcggcaaattcgatcaccccgcctttctcattaccttccagcttcctgatccccagtttctgcgcttgctggcgcagacgggcaatatccagcagggtacgcgccggatctggcagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcagctcgacttctgtttgctggctggtgagatcttccagcgacggctcgcgtccggctttcagtgcatcgacggcgttttccagcaactccatatacagcgagaaaccgatggtttccattgagccgctttgttcttcgccaagcagttcacccgcgccgcgaatctccagatcgtgcgttgccagcgcaaaacctgccccgagatcttccagcgaggcaattgcttcaagacgtttttgtgcatcggtagtcatcgcttttggatgcggtgtcagcaaccatgcatatgcctgatgatgcgaacgtccgacgcgaccgcgtaactggtgcagctgcgccagaccgaagtgatccgcgcgttcaatgataatagtgttggctgtcgggatgtcgatcccggtttcgataatggttgtacaaaccagcacgttgaaacgttgatgatggaaatcattcatcacccgttccagttcgcgctcgcgcatctgcccgtgaccgatggcgatccgcgcttctggcaccagttctgccagccgttcggcggctttctgaatgttttccacatcattgtagagataataaacctgtcctccgcgcaaaatttcacgcaggatcgcctcccggaccaccatgctgtcatactcacggacaaaggttttaactgccagacgacgggcgggcggcgtggcgataatcgacaggtcacgcattccgctcattgccatattcagcgtacgtgggatcggcgttgcagtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgcttgtggttatctactgccaggaaagctgcgcgcatcgccacttctgttttaccaaagccaacatcgccgcacaccagacgatccattgccagcggctgacacatgtcgctaagtaccgcattaatggcctgcgcctgatccggcgtggtttcaaacgggaagctgtcgcagaacaactgatactgctcacgatcgtgtttaaacgcgaagccctctttggcggcgcgttgcgcgtagatatccagcaattccgccgccacatcacgcactttttccgccgctttctgccgcgcgcgtgaccacgcatcgccgccaagtttatgcagcggggcgttttcttccgcgccacctgcgtaacggctaatcagatgcagtgacgacaccggaacatacagtttggcgtcgttggcataggtgagcatcagatactcgccagtaatgccacccgcttccagcgtggtcattccggcataacgaccgacgccgtgctccagatggaccaccggctgaccaatatgcagttccgcaaggttacggatcagtgtatcggggttgatggtgcggcgagaatcctgacgacgacgggcaacgcgttcaccgagcagatcgctttcgcaaatcagcgccagattacgcaccgtatcgacaaaaccatgttcggcagcgccaatcatcagataacgcccacggtcgctggcttcatcaagacgcataatgcgttgcggagcaattttaattcgtgcgagcagttcacccagcgcttcacggcgaccttcactttctaccgagaacaccaccggaccgtcgaaagtctcgaggaacttacgcagcgcatccagcggcgctttttgttgtgcctgaacggccaggtctggcagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccagcgtgtcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatcgcttctacttcctccagcgtgcgctggctgtcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgtgggcaaacgcgctgcataagcgtattcaccggaacaatcagtacgccacgctgcatcgtcggtagctggtaaagggtggaaaggcgcgaggagataatgtcctgatgaggcgaaaaactgtcgtagggaagagtttcccagtccgccagattcatcaccatttgatcggtaaactggctgatttcatcatgcaaacgcagagcattttgcatatctggtgcaatgagtaccaccggaccggcgtgacgttcggcaatttccgctaccagcgttgcacaggctgcgccggttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggcagcgggcagtgaaggcggggagaacaacagatcgctgaatgcacgctgtgaaagttttcttaccagcaagcccgcaacagtacagatgaacaaactgacaaagggataaaccagcaggagtgtcagttcgacttgcggcgaccagcgtgctgcgttcatttgcgcaagcagagttaagctgaatatttcaaccagaatgcgatgggtggtgtagatagcaatggtgttggagccaatcacattcagcaggctggtggagcgcataccgaatcgttgctcgtattgataaaacagcttcatgatcaccacaatcgataccagcgacaacagcagcgagatagtaaacaaccaggcaccgaccgccagaacggtaagcaaagaagccatcagcagatggcggcgcaacggcacctctttaacacaggtcattattgttgcgccaaaccatgcgccaaggctgtaataaggcaaattgcggatcacactgttcattccccaccacggcgtgggaacgaaattaaccgccacactcagcagtacaaacaaggcgaatagtggcagcgccagacggctaaaaattttacataccacgaaatagacaattaacgcatacagataccacaagctggtgctggcggtgatcatcccgtgcaggaactcaccggtggaatcggcataagcggcattggaggcattgcttaaatcgcgctcaggtgccagccactggttcagcgcacttaacgccagccactgcaccacgccccaaagcgccagcacccagaagatgttccagatccgtttatcgagacaatttccccacggtacgctgtcgatatagcggcgaatcaaatagccggatataaagaaaaaaaccggcatacgaaagggggcaaggtaaagattgaaatagatccagcatttgctcaggacttccgataacggatgctgaaaagtggtcagatgcggataaaaggtaatgaccgagtgataaatcaccaccagacaaatacataaccctttgatctggttaatccatagctctttttgtttcatcaggacaacacgctcttttttaatttacatgcggttgatcctgcgggttatgacccgaggtgtaatgggtatctgtctgtattggatgatttttcagattaagatcaggcggcaagattgatgataaaacatggcaatttagccgattgatttacgggggcttttcagattagccctgacgatcacttacagttcagacgtttacccatcttgctttcgcttatatactcgtgtctttgctacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccagaaacggcagtcaaactggacggcgttaatcgcgtcgcacctattactaccggtgatgtggtactgcaaagcgcgcgcagcgtggcggtcggggtgatgctcggtatcgacccggcgcaaaaagatccacttacaccgtatctggtcaatgtgaaacaaactgacctcgagccggggaaatataatgtcatcctcggcgaacaacttgcctcacagctaggcgttaatcgcggtgatcaaatccgcgtgatggtaccatctgccagccagttcacgccgatggggcgtattccaagccagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgatcgtaaaggcgagttgttccaggccgtacgcatggaaaaaaatatgatgggtttactgctgagcctgattgtcgccgttgcggcgtttaacattattacctcactagggctgatggtaatggagaagcagggcgaagtagcgatcctgcaaacgcaaggcttaactccgcgacaaatcatgatggtctttatggtgcaaggggccagcgccgggattatcggtgcgatcctcggagcggcgcttggcgccctgcttgccagccagttaaataatctgatgccgataatcggcgtcctgcttgatggcgcggcgctgccggtggctatcgaacctttacaggtcattgttattgcgctggtggcgatggctatcgcgctgctgtctacgctttacccttcatggcgcgctgccgccactcaacccgctgaggctttacgttatgaataagatcctgttgcaatgcgacaacctgtgcaaacgctatcaggaaggcagtgtgcaaaccgatgtgctgcacaatgtcagtttcagcgtcggcgaaggtgaaatgatggcgatcgtcggtagctctggttccggtaaaagtaccttgctgcacctgctgggcgggctggatacgccaacctccggcgatgtgatttttaatggtcagccaatgagcaaactgtcgtcggcagcgaaagctgaactgcgcaaccagaagctgggctttatttatcagtttcaccacctgctgccggattttaccgccctggaaaacgtggctatgccgctgctgattggcaagaaaaagcccgctgaaatcaacagccgtgcacttgagatgttaaaagcggtggggctggatcatcgtgcgaatcaccgcccatctgaactttctggcggcgaacgccagcgtgtggcgattgcccgtgcgctggtgaataacccgcgcctggtactggcggatgaacctaccggtaacctcgatgcgcgtaacgccgacagcatcttccagttgcttggggaattgaatcgcttgcagggcaccgccttcctggtggttactcacgacctgcaactggcgaaacgtatgagccgccagttagaaatgcgtgatggtcgtctgacggcggaactgagcctgatgggggcggagtaatggcgatgcctttatcgttattaattggcctgcgttttagtcgcggacggcggcgcggcggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaaatcgaggcggtggatcagccgtggactaactggcaggaagcactggatcacgtgcaaaaagtgccgggtattgccgctgccgcgccgtatatcaatttcaccgggctggtggaaagtggcgcgaatcttcgcgcaatccaggtgaagggcgttaacccgcaacaggaacagcgtctgagcgcattaccctcgtttgtccagggcgatgcgtggcgcaattttaaagcgggcgaacagcaaattatcatcggcaaaggcgtggcggatgcgctgaaagtgaagcagggggattgggtgtcgattatgatccccaactcgaatcccgagcataaactgatgcagccaaaacgtgtgcgtttgcacgttgccggtattttgcagttgagtggtcaactcgatcacagttttgccatgatcccgctggcggatgcccaacaatatcttgatatgggttccagcgtgtcaggtattgcccttaaaatgacggatgttttcaacgccaataagctggtacgcgatgcgggtgaagtgaccaacagctatgtttatattaaaagctggattggtacttacggctatatgtatcgcgatatccaaatgatccgcgccattatgtatctggcgatggtactggtgattggcgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagtggtttcactgcaacttaccccgattattgagtggattgaaaagttgatcggtcatcagttcctctccagcgatatctattttattgatttcctgccatcggaattgcactggctggacgtcttctacgtactggtcacagcattgttgctgagtcttttggcaagttggtatccggcgcggcgcgccagtaatattgaccctgcgcgagtccttagcggccagtaaaggcagtacattaaaacaaggagcggcaatgtattacgggtttgatattggtggaacaaaaattgcgcttggcgtgtttgatagcggtcggcagttgcagtgggaaaagcgggtgccgacaccgcgtgacagctatgacgcatttttagatgcagtgtgtgagctggtagctgaagctgaccaacgttttggctgtaaaggttctgtcggcatcggtattccgggaatgccggaaacagaagatggtacgctgtatgccgccaatgtccccgctgccagcggtaaaccgctgcgtgccgacctgagcgcacgtcttgatcgcgatgtacgccttgataacgatgccaactgttttgccctttcagaagcctgggatgatgaatttactcaatatccactggtgatggggttgattctcggcaccggtgttggcggcgggctgattttcaacggcaaaccgattaccggtaaaagctacattaccggcgagtttggccatatgcgtctgccggttgatgcgttaaccatgatggggttggatttcccgttacgccgctgcggctgtggtcagcatggctgcattgaaaattatctgtctggtcgcggttttgcgtggctgtatcaacactattatcatcaaccgttgcaggctcccgaaattattgcgctttatgatcaaggcgatgagcaggcaagggcgcacgttgagcgttatctggatttattagcggtttgtctgggaaatatcctgaccatcgttgaccctgacctggtcgtcattggtggtggcttatcgaatttcccggcaatcacaacgcaactggcggacaggctgcctcgtcatctcttacctgtagctcgtgttccgcgcattgaacgcgcgcgccacggtgatgcgggaggaatgcgtggtgcggccttcctacatctaaccgattaaacaacagaggttgctatgctgtcgcgtcggggtcatcggttaagtcgttttcgtaaaaataaacgccgcctgcgcgagcgtttgcgtcagcgtatttttttcagagataaagtggtgccggaagcaatggaaaaaccaagagtactcgtactgacaggggcaggaatttctgcggaatcaggtattcgtacctttcgcgccgcagatggcctgtgggaagaacatcgggttgaagatgtggcaacgccggaaggtttcgatcgcgatcctgaactggtgcaagcgttttataacgcccgtcgtcgacagctgcagcagccagaaattcagcctaacgccgcgcatcttgcgctggctaaactgcaagacgccctcggcgatcgctttttgctggtgacgcagaatatcgacaacctgcatgaacgcgcaggtaataccaatgtgattcatatgcatggggaactgctgaaagtgcgttgttcacaaagtggtcaggttctcgactggacaggagacgttaccccagaagataaatgccattgttgccagtttccggcacccttgcgcccgcacgtagtgtggtttggcgaaatgccactcggcatggatgaaatttatatggcgttgtcgatggccgatattttcattgccattggcacatccgggcatgtttatccggcggctgggtttgttcacgaagcgaaactgcatggcgcgcacaccgtggaactgaatcttgaaccgagtcaggttggtaatgaatttgccgagaaatattacggcccggcaagccaggtggtgcctgagtttgttgaaaagttgctgaagggattaaaagcgggaagcattgcctgatgcactacgcttatcaggcctgcaaggggacgcaattaattgaatttgcgggttttgtgggccggataaggcgttcgcgccccatccggaataatacacgcgcacttttccggcctcttttatcgtttactcgtcaataacaatgcggcaataaacgtacagacaccaattagccctgcccagagtggcgatattctggtaatcgcaaagctattatcgatatacaaacataaagcctgataacccatattggcaatagtcatcgccactgcaaattttaacgcataaataaaacgagtcgtgtagtaaaagatcctggaaaataagataaacgtcgcagcccaggcgataaaacctaatgtgttggtgctgccggggggagcattttcatgctgttgtcctggatgcggataatacgttagtggcggcgtcgattgttttaatatctgtgcttgtagaacagccaatgcattattgattccctgataccagagatctgcatttaaataagccagcgtgtgattttctatcagaaggccgagatgtttatcgtccagaccactttcaacctggccgttggtgatcataattaaccgtggttcgcgggtagtaaatagtaacagaacacttccttttacatcactcaatgaagatgacgcatgcgccagcatcgctttaccattttgtctgagactggcttcattattaatgtcgggtaaaaccacaataaacggtgcaattcccgtttgttggcgaaaaagctcggctttatgcgcgatctcttcagcatctggtacagtaccggtaacgtccgtaaaaagtgtcttcattattggaattaatggcttgctggctgctgtcagaggcaggagtatcagtaaactgagcagtataatgaattttttcatgggcgggacttccgtttcctgcgtgattttttagaggagggcatacttattaataaaccgacggcgataaaaataacgcccataatgccgataaacccccatttaaaaaaattaacccacgggttatttatctcagccttttcaggatgcccgggagaataataaacattaactttatcgccttcgctgtcttcataaaaatcgctgccgatactcgaattgaaaattagcgtgtaatctggcgtcggtcgaaaggcaacgacgggataccacgaaccatctttacccgtgcgatgagaatgactggagtgccagacggtatcaacaatgacgccttcggtatgaatcgcgtctttgctataggtgaactggttataaaagacaacaacagaaatgaggatcagtaccagaccgataccgaggaatatacgaaagaaaactttactgtcctgactcattagccacatccttgctaactaaaaaacgggcggtaataccaccgcccgcttgctgaattaacgtcctgctttcagcttctgataatactcttcataaatgctgctggctgcgccaacgtcattctgccattcgccatttttaatggtttcagcatccgggtagagtgttttatcgttcgccacttctggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccacaccacgtcaattggcgtacccgcctggcgtgcaacgaaagcagaaccgttccagatcatgccgaggttaacttcgccttccatgtacgggttcgccgggttatcggagttaaaggctgccacgtttggcatcagttttttcagctcgttatatgcagcttcaatctctttcggatcggtggtgttaccggagtagcccagcttacgcagcgccatctggaacacttcacgggcatcgtcggtcaacagcaggctgcctttgtactctggcttccacagatcggcccagctggtgacagatttcggatccaccgcatcaccgttaacaccaatcgccgtcgcaccccagatatacggaatggagtagtcgttattcgggtcaaaaggcttgttgagcatgtctggatcgagattgctgaagtttgttaacttcgacttgtcgatcttctggatcatcccttctttacgcattttatcaacgtaataggttgaaggaaccaccagatcataggcaccgtctttgtatgttttcagcttggcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaataaccatcaccagcgacagcaccagtaatatggttgccagcgcgttaacttccggcgatacgccgactttgaccatcgaataaatttttaacggcagaatttcataacttggtccggtgacgaacgaagaaactaccacatcgtccatcgacagggtaaagcttaacacccagcccgccgccaccgctggcattgccagtggcagaatgatttttcgcagaatggtaaattcgctggcaccgagatctttcgccgcttccagcattcgcacgtcaaaacctttcaggcgcgaatacaccgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggcttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaagccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcaaacgagaagcgcgccagtaaaccagcaacatcaggcccattacgatagtcagcgtaatgctggtagctgcaccaaacggccagtcacgaatattaaggaactggaccttgatgacgttaccgatcagcaggtttttcgcaccgcccatcaggtcggatacatagaacaggcccatcgctggcagcatcaccagcagacatccggcaataattcccggcatcgtcagtggaataatgatacggataaaagtctgtaacttgctggcaccgagatcgcgcgccgcctcaagcaacggcttatccagtttttcgatactggagtacagcggcatcaccataaacggcagcagaatgtaaaccagaccgataatcaccgcactgggcgtgaacatgatacggattggtgtgtcgataacgcccagccagagcaaaaactcgttgagatagcctttggtgctgaggaaaattttcagcccgtagatacgaattaatgagttggtccagaacggaacaatcagcagaaacagcagcagcggacgcaccttgtgtggcaacttcgccagaaaccaggcaaacgggtagcccagcaccaggcaggcgagggtggcgatcagcgccatattcagcgagtgcaatagcacttcaaaatagagcggatcgagcagacgcgtgtagttatccagcgtaaagaccattttgacaaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagttcaacaaccgactccagcgtcatgcctttgtagttacgctcgcgaacgtaaccaatcagcccttcagcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtctagacgttcgatgacagtggcgttaaacatattgatttcgccaatgaagccggcaacaaacaggtttttcggctcttcgtagatttcacgcggcgtgccgtcttgctcaatgcgaccatcgcgcatcaccacaatcctgtctgacatggtgagtgcttcttcctggtcgtgagtcacaaagacgaatgtaatgccaagcttacgctgtaacgctttcagctcgttctgcatttgcttacgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccaactgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaactcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcaggggtaaaagtgacctgacgcaatatttgtcttttcttgcttcttaataatgttgtcacaaaaagtgagggtgactacatggataaactacttgagcgatttttgaactacgtgtctctggatacccaatcaaaagcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacagaaaaaaattccgcatggtgatattcgcgtcgcctttaccccggatgaagaagtgggcaaaggggcgaaacattttgatgttgacgccttcgatgcccgctgggcttacactgttgatggtggtggcgtaggcgaactggagtttgaaaacttcaacgccgcgtcggtcaatatcaaaattgtcggtaacaatgttcatccgggcacggcgaaaggagtgatggtaaatgcgctgtcgctggcggcacgtattcatgcggaagttccggcggatgaaagcccggaaatgacagaaggctatgaaggtttctatcatctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgcgattgcgatattgaaccggaactgaaaccgatccgcggtggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttaacggcgcaacggaagtaagcgaaaagggatgcggcatgtgatgccgcatccggcttaaatccaaacttacccttcgaagaaccaatacccgctattgaccagcgccgcgagcatcgcgaggaatgacggatcttccagcgcatcgccaaaattctccgcagtcagcgcaatgttgctggcgagtgcatccagtgccggacggtgcggggaatcgatcttctcaccattggcatacacgtcgtcgccaatgcgcaatacgcgcagaccacccaggcgcaccagcacttcaccttgtttcagcgcatcgtagatttcatccggctgataaggcggctctggcggcgcgatatccagttcatgacgtgactgggatataaactcgccaaaccattgcttaaagtgttccggctggttgatcaattcgagcatcatctcacgcagtttatccatctcttgcggcagaacatccgcaggatgagcgcgaggtggaacatccggatcgctgtagtagttgccgcccagttcacgttgcagcacataatcggcaaatccactaatcagttcccgcgtatttggcgcgcgaaagcccacggaatagttcatcgcattttccagcgcgtagccttcatgcgggaatcctggcggaatataaagaatatcaccaggctccagctcttcatcgatgatggcttcgaacggatcgacctgtaacagatccggatgtgggcagtgctgtttcatttgcagcttttcgcccactcgccagcgacgacgtccggtaccctgaatgataaacacgtcgtactgatcgagatgcgggccgacgccgccgccgggtacagaaaaagaaatcatcagatcatcaatacgccagtccggtagttcacggaacggtcgcatcagcgcggcggtcggctcatgccagtggttcactgcctgtaccagtaatgaccagttggtttcaccgagatgatcgtagctttcgaacgggccgtggctgacctgccatttgccatcctggtgactgaccagtcgactgtcaacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatgggcatatttattcatctttcggcgcagaatgctggcgaccaaaaatcacctccatccgcgcaccgcccagcatgctctctccggcgacgattttaccctcatattgctcggtgatttcgcgggctaccgccagccctacaccttgcccagggcgtaaagtatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcattatccagcacgttgcccatcacctcgacaaaatcgttctgctcaccgacaaagctgatctctggcgaaatatcgagagagatattgacccctttgcgttgatacactttgttcagcgctgaggtgagattgtccagcagtggggcgaccggatgcagctcgcggctgagcaatgtcccgccgcgcatactggcacgatgcaggtagtagccaatttgctgtgaaatgcggctgatttgctccagcattaccggctcagcatcactgacgctcatcttttcactacgcagagaacgcagcgtactttgcagcaccgccagtggcgttttcagactatgggtcaggtcggtgagcgtcgtacggtatttgtcgtaacgttcgcgttcactttttaacaatcggttcaggtttcgtaccagactggtcagttctcgcgttgtggctggattgagcaattcgcggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaattttggcatccgcgatgttgccgggtagacgtttactgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagcgtcatggtggggctttgcttgtcgatattttcgggtaactcgacatgcaacttattgttttcccacttcgcaagggtatagaacagattgctctcgccacgtaacagccgaaacgtagttttatcgaaactgacgctataaccgatcagcgcgaccattccgtaggcaagcgaaagcaccagtactaccgctgccgttgccaacagaaaacgtacccgcagcgagagcgggaaaaaaagacgcagtaattttttcatcagcgcaattcgaacagatagccctggccgcgaacggtggtaatcacttcttggggatattgtgcctgaatttttttgcgcagacgtcccatcagtacatcaatggtatggctttcccgcagctccgcatccggatagagttggagcattaacgaatctttgctgaccactttgccattattgcgtatcaacgtttccataatagtgtattcgaacgcggtcagtttgatcacttcgtcattaatagataattcacggcgagagagatcaacctgaaacggggggagcgaaatgacctgtgaagccagaccgctattacgccgcattaatgcctgcattcgcgccatcacctcttcaatatgaaacggtttagtcacataatcatcagcaccggcacttaatacttcgactttgtcctgccagctttcacgggcggttaataccagaatcggcagtgaaacatcgttgctacgccagcggcgaatcagtgacagaccgtcctcgtctggcaatccgagatcgacaatcgcaatatccggtatatgttcattgagataataatcggcttctttggcatcttctgcgtcatcgacctgatgaccagcatcctgaatctgaactttaaggtggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaataaaaagcggataatcttaataagcaggccggacagcatcgccatccggcactgatacgaggtttatttcagctcatcaaccatcgtgatagctcgaccaatatagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagcagatggtcacggttcacttccagtttgctcacgcctttcagggtggattgatatgcaatcaaggcataaccgatacccacgccgaggttacgcagcacggtagagtcggtcaggtcacgctgccagcgggaaaccggcagtttgcttgccagatgctgcaataccgcgttggaaaggcccagattcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatagtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttatagttaccgaccgcgccgttgattttgccgaggatctccacctggttaagctggcggtactggcgctccatacggtaggcgacgtttgccatctctttaccgatggttgacggcgtggctggctgaccgtgggtacgagacagcagcgggatatcgcgatactgaacggcgagatctttaatgccatcaatcagttgacgccagtatggcaggatcacttcatcacgcgcggttttcagcattaatgcgtgggagaggttattgatatcttccgaagtacaggcaaagtggatgaattcagaaaccgcgtgcagttccgggatctccgccactttttctttcaggaaatactcaaccgctttaacgtcgtggttagtggtacgctcgatagttttgatgcgcgccgcatcttcttcgctgaaactggcgacgattgcatcaaggtaaccgattgcgtcggcagcaaaagcaggaacttccttgatcgctgcgtgcgcggccagtttttgcagccaacgtacttcaacttgtacacggaatttcagcaaaccatattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgtccgccgccgacctggtgccagagcacggcggcgcgaatgcctgccagcagggttgcgcgaactttcgcctgcacttgtgggctttgcagtacagcaggggaaccggtgacctgaatgcgcgggccaagcgggctaatcacatcaacatagatagcagccatcgcgctcatcagcgtttcggactgtaaatcgaagtgttcgagctggcgttgcaggccgttgatccggttgcccagagtgtcgagcgcgcctttcgctgaggagagtttgcgctcaagcaccatcaagctgagtgtgtagcgggttaattcggcgtttaagccctggcgactgctggcattgagcacgccgagcagggtttccagcccgacgcgcaggttggcttcgctaccgccaaaaaccgccagcgtcgagctggggttcatatcaataatactgttgagtgagacgtgtagcgcatcggcatcacaatgcccctggtgagcgagttgttgcaccaggcgtgccgactgacaaataccggccagggcgagggtgatgtcatagtaattctttgccacgttcactgcttccttgttttaagtaaagataataatcagaccggcagcggcagacgctgctcaataataccgccaccgaggcacacttcaccgttatagaagacggcagactggcccggcgtcacggcggcaaccggttcatcgaaaatcacttcaatgcgatcatcgtccagcgccttgacggtgcaagggatatcggtctggcgatagcgggtttttaccgtgcaacgcatagtgccggtgaatggttcgcgatcgacccagtgcaactgctgggcaatcaacccgacagacatcagccgcgggtgttcatggccctgagcgacaaccagaatgttgttttcgacgtctttgtccaccacataccacggttcttcggtaccttctttggtgccaccgatacccagacctttacgctgaccgagagtgtgatacatcagcccctggtgctcaccaatttcatcgccatcgacggtaatgattttgcccggttgcgccgggagataacggcccaggaactcgcggaatttacgttcgccaatgaagcaaatgccggtagagtcttttttcttcgcggtgaccagaccaagatcttcagcaatcttacgcacctgcggtttttccagttcgccgaccgggaacaggctttgcgcaatctgctcatggctgagcgtataaaggaagtagctctggtctttattgctgtccagaccacgcagcaggcggctcttgccatcgacatcggcccgacgtacgtaatgaccggtagcgatataatcggcacctaaatcttcggcggcaaattcgaggaaggctttaaatttgatctctttgttgcacagaatatccggattcggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggataacgttgcccgctttgataacaacgaatactttccgccaccagcggcgaacgaagatttgacgcctgtaaaatttcttcggcgctgacccaacggcagcagtcgatatcgctgtcatgaggctgggtcgggcatatttgctcaagctcaatggcaaagaggaaacgcaaaaacggcgttttatctggcgcaatccactgatgcatacgaataaagtgttgcggctgcgcgctgatgccggtttcttcccacagttcacgggcggcggcttccactaaggtttcatcggcttccagatgcccggcaggttggttccataacgctttaccattaatcgtctcttcaacgactaaaaatttgccttctgcgtgcaccacgcaagcaacggtaacgtgcggtttaaacattttgcatccttaatctgtcacttctcgccattcaccattggcaagattatccaaagagtaatcacccatcgcatagcgaatcagtcgcagcgtggggaagccaacatgggcggtcatgcggcgcacctggcgattacgtccttcatataaggtgatcttcagccagctggtgggaatacttttgcgttcacgaattggtggattccgcggccataaccacgcgggttcgtcaaccagctccgcgccggcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagcaacccttcgctatcgcggtcaaggcgacctgctgcataaacaccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggcagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaatgccgtagtttgttaaatttattaacgggagcgtaacgctcccgttgttttttgttaggctgctaacggttatcaaaattttatcaaaaaaagttatcaaaacccctcggtagttttggggtaggctggccggtcaggtggtagttctactactagtctcccacatagatattccttagctttttattattgctggcggacgctcgttaatatttaaggtcttcattgattaagacatccccaaagttagttatgtattcactgttattaggacaattatgaattaccactccttacacccgctcaaatattgttaaattgccggttttgtatcaactactcacccgggactcgccaggggacagccaacaggcattgggtgcaatcaccttagcgttcaggtacatgcggaatgtaaaaaaggccgcgagcgcggccccttcacatacatctttagtactgagactgtttaacctagggaattattatcgtattatattgcattacaactcccaacagtgacatatgaacttcctgctttactccacgactttaatatttcaaggccatgtgaagaacatatttcttgcactgcgagttcatcgagtaatccatagtaagaaacactttttgaatttttgtaaatgtatccgtaaagatgttttcttcctgtttcgtattttttgaagtatgagcttttatattgatttacaataagagtctcacctcctgattttagtaatctcttgatgctaagaactattttgtcgattgtatcccgacaaggaacggcagagagaacattagagcaaaggatgaaatcgtaacccccaattattttgtcgacatcctcgaaagcaactgtatttgcatttttataatatcgtgggacatagtcaataattttagttttaattcctctaataatttgctctctttcaagttgccttttcgagtctagaaaagtaacttcatcaaatttactgattaattcatcagaatatctaagttttccgcagccaaaatcaagggcgtggccatttttctcaatgcttctaatatactcgcaaagatatctagagggcatcgtatgaggttttgctgcattctctgagcgaatattaactccgtgcatattatagttcaaagcaagtaccattcaattaatgttatttttagtgaaaaattcttttattttatcgtccgggatttttccgacttgactttcagttctgggcttaactgtcaaagcaaagataataccactcactgagaatgataaaattacaaaaaagaataaagacagcaaagaaccttcaacatgaaaaatatccatttgtttgcaaaaaaagattattaggaaggaaattaatgcaattatcgaaaattcaaaaaatatccaaaaatagtatactttattccagaagagttcaatataatgtttgtcttcaatttttcttacttcagggtaatatagattgctcattacattgtgagcttcatctttatttaattttctgttgactccagctctccgtgataacggttttataattagatgcttatcccaaagatatcgcacccgaagtagtttggctgcattgttatgtaggtctaacgcaccgctaattaaatatgcaaaaatcgcaaaagcacaaggtaatataccaaaagatagtgcccaattaataaagctctcatgatctttaataggtgggacatacttggttggtaatgttattaaagggatgtattcgtaaataactagaagtatgcaatatattagcgtatttaagaaagttgctttatgaagtttaggcaacatttcattataatttttggggggttcgaacatattattcacctgagtcacgctttaggatagtgtaatggtaatatttaattaagtgtcattatatacttttcagtaggttagttacaattttttgtatctgttcaggctgacctagcttcgctgacagacaatattgtgatcagtagcacgtatcgaggaggagtagcgctacaaatttgacgctgggtgagaatctgaaattgatagaaatgaaataatgaaataatgaaatgatgaaatgatgaaatgatgaaatgatgaaatgatgaaatgatgacagagtgtccagtgggcacggatggtgtcttacgacatgcttaccttaatcgttcccagtgtgcctatagcagatattctaaacatgtcgataattcattacgcatatagtatcgaacatagaaaaaactgaagattcatcttattttgtatatactacctagcccaacaatgtagaggttaacgaaaaatgcgctcaccaatttgtcatcttttctcagcaattaattcatcaccatttaagattgcaccagagaaggagcaagatcttaaaacgatagttgacgacaaaaaaattataatttcagttgtgagtgaacctggttttaatatccgagtcaggaagaatgagagtaataattcacatgaaatagttctaacagtagcttcacttgaatatatttgggcattttccaatttcttttgggtttttacgcaagagtactccaaatctcagaaaaataatgatgagcactttgatttaacaggaaaaaataggcttaaaaagtctgatgaacttcttaaatgggcaaggaaaaacttgcaaacaacaggttgcgaatcatggcctaaaaaatgtcccaagccagaagcatatttacaaggaagcgaagactcacaagttgctagcgagatatttctttgtgctattgcttggattcttcatcatgaaataagtcatgttgttttacagcatccattggtcactacagcattctccactcaagaggagcgtgaagcagattcacatgctacaaaatggatattaggcaacctgtatgaatccgctcctgaattaaagaaacgtgcacttggcattgctacggcagtgctttgtatacaaagcttagaagttgaaaattacttctgtttacaaaatacacacccagctgcatatgagcgtatatattcgaatatttcatgctaccctgtcggaaatgaagagttgattgaagctctatgtacagtgatgcttcaatatcttttccatggcaaaaatatcaatgtgaatctagatggggagtccttttcatcgattttaggtgatcttctctgtgatatttcacgtcttaccagtaactgatatggctgtccgccgctcgcttaaagtggactttttagtttttatcatgtgcggtgagaaattcaatgtggcgttgagatgcttaaaggttcacaacgctactttgctccatcctttacctcgatcatcatgataacgatcggtttgttgttgtgttttatgaccaagtagtttttgtgtgtctaacccctgttctttatacagacgttcagataaagacctttgctcatggaatgtcgcaggtgaaccctctccccagtcaattcttgctaaatctctcgctttactaaaattcatcgtcaatgtattggctttaacctgcgctccgcgctctgcttgtgaagttgaacgaaaaaaatgcactaagtatgcactgactgcatagtcacggcagcgggctactacatcgcgtaaactccagttaatcgcattgaggcgaagagaaagaggaattgcgattttgctcccggtcttttcctgaatgacatgaagatgatcatcccaaatatcgctaaatttcatacgcgaaatatcacctaaccgctgaccagtaaccagcgctaacagcatggcatttcccatgtaacgatgagtagcgtctgcgatatcgaagatttttttccattcttcaaggctcagccgttgtcgggtaatttttcttcttggttgtttagtggctaatgctgggttatagccaggaggtacttctccgtagtgctgcgcctctttgaaaacatcaatcaggacggagcgaactacttgtgccattcttggccgcccagcggcgatatactcatcaagcaattgtgctatatctctgacatcaacggctgagatcaacttcattcctgctcgttctctgagcaaggatactggtttagctttttgtttataggtgttgagtcttatatcaccacttttaagcctgtcatcctggatcgcttgatagcgatctaaccaggttgacgttgtgatagcctttcctttgctggttgcgatcctgtcactgatagccagaatctgccgggttctttgttcagccaggcgagtgttggcctcagtggcaatagcgatagcttcagcttcgtttgttcccaaagcatggaattttcctgtcactggatgcttataccgccaatagactttatttaccttcctactataaagcggatataagttagggactgaaacattattcttacgcggtctggctgccattactcaaaatccgttgcaaaagtaatgagtcatttttcttgattacaggtgttaccaactccccaactaactcggcgtcctcacgcactcgccataaccggccttgtttcatggccggtggacaaaataaattctgcttagcataacgacgcaatgtggacacacttggaggattacttctgtatttttcagcagcccattcttcaagagttaacatttgaagcatatgcgatcaccttattactacactaactgcttagtctcagcatatcgaccctgcacggtcggttagtttctccacaaaacagagaagagcacctgtggccacagctatcaggatgggtcgggttattaacccgtcatccggggatactcttctctgttttgtaaaaagggcggtaccagaaaggactaaggaaaaaactggtaccgccaagactacacacagcataaagttgtggtgtcgggtgcccccggtgcctggcgaaggttgcacaccaggcgggtgggtatccacagaaggtcgattgtcagcctcaaccttaacccgcgtgcgctgagccgcattcaccacaacgctaaggattctctctggttgaaaatacttagctgttatgtgcctgtcttttcaccacttcaggctcggtggtatgctggagttctcacacagccagcaagcaaggaaacttaatgaaccagttttatgttcacgttcgtctatttgaagacacagccgaacagaccaaaaaatttgaagaattaatgcttaactttctgtaccagaaaacagttaaagagtctgacgatagctgctgcagactgattccagagggatatatcctcaaaagtacaatgaactgccaacaaatccttgatcaaacattttcaattgctaacagtgccggtgttgacgcaaatatatttgtctgtaaatttgaacaaagcgcatgcttacttccgtctgcttccttagttggtaacgatttcgttcattacgatcttacgcctaagcccatcaagctcgattcttaaagccttaaccattgtgtcgtgataaacacggctcaccttctctccattgcatggcagaggggtgagtgtgttagccatgaaattcatgaactcggttcgaccaggggcttgcgccccgcaagtctttaatgcctgttttgctaacaaaatgcgggcctcagtgcctgcatttggctctatctgctgcaaacgtttagcgtcttccagcaacaatgcgatcacatgcttcaaattctgctcattcatctattctctccactgaaatcatccgctaacgaatcatcccggtcttcgtacgtaccgggcgggctacttcgtgggcgtcctgcctgtttgttgtttctcttgggtacattatgtatctcaaaggtacattgtcaagtataaaaaaacctgccgaagcaggttcataaacattgattaggctttgattttgtatcttcttggttttcctgagaaaatcacagtaccaattatagagcaattaccgttgatcttaatgtaaggctcaggccagtttgggtttaacgctttgagataacgctgtgtcccatcttctatcaaccttttgaaggtggtttcacctgtatcgtgcatcaatgcaataacgtcgtcaccgtggcaggcaggtacttcaggatcgacaaaaatcatgtctcccgggcggtactcatcaatcattgaatcacctattacccgcaagatataagtcatttccccacagggtacagggcagggatacgtttctgctgtgctcaaatcaacctcagaatatccaacttctttccatgctccggcctgtacccatgatatgacagggactaatgtgatttgtttattagtgattgaaacatcaggtttttttgtgatgttcgttgtctggtgttcttgatcgagccatcctacaggcaggtcgaaacatttttcgatgtgtcgtgccatgctgtcaccgatatttttagtagcaccatctcccataaacctgctggtctgggttggctcgcgatcaatcatagtggcaaaggaagaattcccgccaacaccatctctcagttttctggcgttagaccgccggatgtcatggattgttttcataacgaaattaaaacccttgtaccgttaaggtacaagtatcttgaaggttcatttcaatcatgtaatatgtacaccggaggtacatattgtatgaaagcgtattgggactctttaaccaaagaacagcagggcgagttggccggaaaagttggctcaacacctggctacttacggctggttttcaatggctataaaaaagccagttttgtgctggctaaaaaacttgagcaatacacatcaggtgcaattacgaaatctgacttaagaccggatatctatccgaaagattagcagaacactttcaatttttaaccacagaacgatgaggctaatcgtgggtaagcatcactggaaaatagaaaaacagcctgagtggtacgtgaaagctgtcagaaaaactatcgcggcgttgccgagtggttacgctgaagcggctgactggctcgatgtaacagaaaacgctttattcaaccgccttcgtgcagatggcgatcagattttcccgctgggatgggcaatggttttacagcgtgctggtggcactcacttcattgctgatgctgtggcgcagtctgcaaatggcgtctttgtgtctcttcctgacgtcgaggatgtggacaacgccgatattaaccagcgtctgctggaagtcattgaacagatcggcagttattcaaaacagattcgttcagcaatcgaagacggtgtagtggaaccgcatgagaagacagcaattaacgacgagctgtatctctcaatttcgaagctgcaggagcatgcagcacttgtctacaaaattttttgcatttcagaaagtaatgacgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgcagagtgggctgtgggtgatttcaaccggcagaaggagacagtcctttgcgacaagttaaccgctggttcaaagatcactacggagtgcccgtcagagtcattcgttgggagccggaaacacaacgggttatctacctccgcgaaggttatgagcatgaatgcttcagcccgctcgaacagtttcgtcgtaaattcagggaaatagaggtcggtcatgagcactaaattaaccggctatgtatgggatggttgcgctgcatcaggcatgaagttatccagcgtggcaattatggcccgcctggctgatttcagtaatgacgaaggtgtgtgctggccatcaattgaaaccattgcccgtcagattggcgcggggatgagtaccgtcagaacggctatcgcacggctggaagcagaaggctggttaacgcgtaaggcgcgtcgccagggtgatggttcatcaccccactgtgccgtggtggatgaatatcacgagcacgccacagatgcgctttacaccacgatgcttaccgggatgggggcgcgacgccagccactgatgtgggccattaccaccgccgggtacaacattgaggggccgtgctacgacaaacggcgggaagtcatcgagatgctcaacggctcggtgccaaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggcgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgccggacagccgaacgctttcagaaatgggtggaaatgggcgttctgaccgttaccgatggtgcggaggtggattatcgctacatcctcgaagaggccaaagcggcgaacaaaatcagcccggtcagtgagtcacccatcgaccccttcggggcgaccgggctgtcacatgaccttgctgatgaagacctgaaccccgtcaccatcattcagaactacaccaacatgtccgatccgatgaaagagctggaagcggcgattgaatcggggcgctttcatcatgacggcaatcccatcatgacctggtgtatcggcaacgtggtcggcaaaaccattccgggtaacgatgatgtggtgaagcccgtcaaggagcaggcggaaaacaaaatcgatggtgcagttgcgctgattatggcggttggcagagccatgctgtacgagaaagaagacacgctgtctgatcacattgagtcctacgggatccgctcgctttaactgaggtaattatgatcatgctgattctcgcgcctctggtgggcgtgctgggtgcgcttttgctggcgtatggtgcctggctgatttatcccccggcgggttttgttgttgccggggcgctgtgcctgttctggtcgtggctggtggcgcgatatctcgaccgtacacagtcgtctgtcggcggaggtaaatagtgttcttttcgggattatttcaacgaaaaagtgacgcaccggtgaccacgccagcagagctggcggatgccatcgggctgtcgtatgacacctataccggaaagcagatcagcagtcagcgggctatgcgactgacggcggttttttcctgcgtcagagtgctggcagagtcggtcgggatgttgccctgcaatctgtatcacctgaacggcagcctgaagcagagagccaccggcgaacgtctgcataaactgatctccacgcatcccaatggctatatgacgccgcaggagttctgggagctggtggtcacctgtctgtgcctgaggggaaacttttacgcctacaaagtgaaagcatttggcgaagtggctgaactgctgcccgtcgatcccggctgtgtggtatatgcgctgggaaggtgtcagcgatggcctgaaggtgaccgccgggagtgttattcagcgcgatgacctggtgcagtacacgacaactgacgatgcaaccagctccggtggtgtcctgcgcgtgccgatcgcctgctcaagtgcaggtgcggtcggtaacgctgacgacggtacggcattaatcctggtcacgccggtgaatggtctgccgtcttccggtgtggctgacaccctgacaggcggatttgatactgaagagctggaaacgtggcgcgcccgcgtcattgagcggtattactggacgccgcagggcggggctgacggggactatgtcgtctgggctaaagaagtgcccggcattacccgcgcatggacataccgtcacttgatgggaacgggaactgtcggtgtgatgattgccagcagtgacctgattaatcccattccggaagaatcaacggaaacggcggcaagacaacatatcgggccactggccccggtggcaggctctgatttgtatgtgttcaggccggtggcacatacggtggattttcatatccgcgtgacgccggacacaccagaaatacgggctgccattaccgcggagttgcgttcgttcctgctgcgtgatggttatccgcagggagaactcaaggtatcgcgtatcagtgaggcgatttccggtgcgaacggggaatacagccatcagttgcttgcaccggtggacaatatctccattgcgaaaaacgaactggcggtactggggacgatttcatggacgtgacaaacgatgattacatccgcctgttatcggcactgttgccgcccggtccggtgtggtcagccagcgatccggcgattgccggtgcggcaccgtcattaacccgtgttcatcagcgtgcggatgccctgatgcgggagctggatccgcgcaccaccactgaactgataaaccgctgggagcgtctgtgcggtctgccggatgaatgtattccggcgggaacgcagacccttcgccagcgtcagcaacggctggatgcgaaggttaacctggcgggcggcatcaacgaggatttttatcttgcacagcttgctgccctgggcagaccagatgccaccatcacgcgatacgacaaaagcactttcacctgctcatcggcctgtactgacgcggtgaatgcgccggaatggcggtattactggcaggtcaacatgccagccaccaccaactccacctggatgacatgtggcgatccctgtgattccgcactgcgtatctggggtgacaccgttgtcgagtgtgtgcttaacaaactctgcccgtcgcatacctacgtaatttttaaatatccggagtaatccatgcatcgtatagacacgaaaaccgcgcagaaggataagttcggcgcgggtaagaacggttttacccgtggtaacccccagaccggcacgcctgccaccgatctggatgatgactactttgacatgttgcaggaggaactttgcagcgtggtggaggcatccggtgccagcctggagaaggggcggcacgaccagttacttaccgcacttcgcgcgctgctgttaagccgcaagaatccgtttggcgatatcaaatcggatggcactgtgcaaacggctctcgaaaaccttggtttgggagaaggagcaaaactcaatgcagcaacggctacattaggacgcaccggtttcatagctataccggttatgattggtggtattgagcaatcagtaatcattcagtgggggtggaatgccgcaaaagcatctgcctctgggggggatggaaatacagttgtattcccggttgcgtttaataatgcctgtgttgccgttgttgcaaattatgacaatgtcagcgcacctatcaatgcagtggcaacggggggatatacaaccacttcgtttttattacggtgcgcagctcaaacgggtagttattactataactggattgctattgggtattaagatgaaaatatactgttgcttaaataccgttggtttttttatggatggctgtggcgtcattccgccagattctaaagaaataacggcagaacactggcagtcattattaaaatctcaagctgaaggaggcgtgatcgatttttctgtttttcctccttctattaaagaggttatccgtactcatgatgatgaagtcgcagatgcgaactttcaaaagcagatgcttatctctgatgcaactgattttatcaatagcagacagtggcagggtaaggctgcattgggaagacttaaagaagatgagctgaaacaatataatttgtggctggattatctggaagcactggaactggttgatacatccagtgcgccagatattgaatggcctacgcctccggcagttcaggccagatgacatccggcgcggtgctggtatctgttgccgtcaccgcgtcaatgtaatccagcacagcgttaagtctggttgtttctgcctgcgtcagtttacgtccggcctgcaatttcagttgaatcagactaatggaagccattgcagcatcaatcagtgactggcgctgtgcttctgccgcgtctactgcggcgctatgctgtgcttcagtatcggtcacccatttctcaccatcccatttatcgtatggagataaaggggcgatagtggttgtattttcagggtaatcacccggagctttgatttcttttgattctccagttttggtgctatagaccgtttcaccgcgatggtctggcacatattcccatgagttaaaatctgcagaacggcagattgcataaccagccttatgtgtaccaggggcatctaaacaggaacatgccggaatgccgacaccaacggcaagatattcatttgaagtggaaatatattcccgtgtttcaccatcgtagttataaacggtaacatcccctgcctttgttgcaataaggtcactatttaatattgctttatgcatcaggctgccctcacgatatagttaaatgcaatattacgcggacgcgtttctgaggctgcggcacctaaaccatccactgattgtttatatgttttaaaggttccataatccggggctggtaatccggcatcgtttgtgtttcctcttttgataatgtcagtgccactatttacccatatttcatcaaaatagaaattaatcgttgcatcagtcacaatcgtggatcttgacggtaatccatgagcatgatcctccgttgcatacccctgaatacttaaaatagagcgacctgtatcaatcccccgcccgtcatcccagccacgaataaactcaccacgtaaatcaggcaatttatttgtcggataagcctttgccagttccgggtattcttcagcagaaaaagcggcaccattgcatttcagccagcctgttggcggagtggctgaaggccacggaaccgggacaccaacaggtaatgcagagccttctcccaaaccaacgtttatgaaaatgaagaaataacaagcaaatggcatcattcctgcttttaccagggggatttaacatgcttattggctatgtacgcgtatcaacaaatgaccagaacacagatctacaacgtaatgcgctgaactgtgcaggatgcgagctgatttttgaagacaagataagcggcacaaagtccgaaaggccgggactgaaaaaactgctcaggacattatcggcaggtgacactctggttgtctggaagctggatcggctggggcgtagtatgcggcatcttgtcgtgctggtggaggagttgcgcgaacgaggcatcaactttcgtagtctgacggattcaattgataccagcacaccaatgggacgctttttctttcatgtgatgggtgccctggctgaaatggagcgtgaactgattgttgaacgaacaaaagctggactggaaactgctcgtgcacagggacgaattggtggacgtcgtcccaaacttacaccagaacaatgggcacaagctggacgattaattgcagcaggaactcctcgccagaaggtggcgattatctatgatgttggtgtgtcaactttgtataagaggtttcctgcaggggataaataaagttaaagacactttgtgtacaaaagaaagtaaaacaacagcaacttgttgcaattttatcaataaaagtagtattgtcgtgaaaaattgattaaagattaatattatgcatgtttttgataataatggaattgaactgaaagctgagtgttcgataggtgaagaggatggtgtttatggtctaatccttgagtcgtgggggccgggtgacagaaacaaagattacaatatcgctcttgattatatcattgaacggttggttgattctggtgtatcccaagtcgtagtatatctggcgtcatcatcagtcagaaaacatatgcattctttggatgaaagaaaaatccatcctggtgaatattttactttgattggtaatagcccccgcgatatacgcttgaagatgtgtggttatcaggcttattttagtcgtacggggagaaaggaaattccttccggcaatagaacgaaacgaatattgataaatgttccaggtatttatagtgacagtttttgggcgtctataatacgtggagaactatcagagctttcacagcctacagatgatgaatcgcttctgaatatgagggttagtaaattaattaagaaaacgttgagtcaacccgagggctccaggaaaccagttgaggtagaaagactacaaaaagtttatgtccgagacccgatggtaaaagcttggattttacagcaaagtaaaggtatatgtgaaaactgtggtaaaaatgctccgttttatttaaatgatggaaacccatatttggaagtacatcatgtaattcccctgtcttcaggtggtgctgatacaacagataactgtgttgccctttgtccgaattgccatagagaattgcactatagtaaaaatgcaaaagaactaatcgagatgctttacgttaatataaaccgattacagaaataaaattatttattaaagtcacatttaagacgtaataccctacagggtaaaaattttctctgatcttaacttctgcaaatgttaactgctatttttatgctaaaaatggttatcaaaactcaaaaacacatgtttataatcaatgagttatagaaatgctaagggctaatgagttatatgcaaattagtaaaattatgttgctatgtcagatagttacgatttagtcatctaactaatgctgcgccatatgggttggactgaagcggctgacctgattgttaaaggtatggaaggcgcaatcaatgccaagaccgtaacttatgacttcgaacgtctgatggaaggcgctaagctgctgaaatgttcagagtttggtgaagcgatcatcgaaaacatgtaatctctccatgtgttaaatattgaaacgggcgtataacacgcccgttgttttatttatgtggatattattaatagcatatcgagcatatttatatgaagcccattacttgagcccatatgggcatatttttataatgcaactattatgtaaacatttatttgttattttgctttctcctggaggacactcttgactgcttttgagtaaactccataaatccttgttgaatggtgcgatgtgataaatagtaataggatattctttatccttaaggataataccagacttaaccggtgtaaatatactgccaggagggagaaatatagtagattgataccagatgatcattttcatattaccccatatggctgaaaaagatataccacatgtaggttgaattaccgtgtcaattactatccacttcatttgttatgtcttatcccacggtatttaatatggttcattaggatgtttatttcttgattttgcatatgagtatattacccccccctcaaaaaaataaattaattaaaatgatggcttatataaaataaaatttaaagcaaggaatctcaatggatgttaaacaaaatgagattttgtgaaagcaataaattattgacttcgttttagatttgtttagctataatgttatacattcaaatgactgaacatcctgtaattaaaacatagcctttatgctactttgtgccaatttgctaaacattatggttgcctttttatataacgataataatgaatataagcatgacatgagaataaggtttcaatttttgagttatataggaatgatttaacctgttcctggctaaaatacatataaccggatgatgactaaaccaaaatacatgtgcgttaagtattgaaacggacgtgtggcacggccgttgtttttataaatatgttaaccgttataaaataacgtatcaaaagtcaagtgatcacatttcaaatatcaagttgatagtattagtctggtgattatttatgggtgacaataaaaagacagtattaatcatccatagagatagtctctgcacttttatttccattatgctaatgccttactgaattatgaagcatttcttaagtatccaactttagctagattaatggtttattattttctacatcttcaatatataaaagcgtattatcaatggcgtagtaactgcgtttgttatgattaacatcagtaacccaccggaaaacgcccgcgcctgccagtgttgaacagtattcccgaaatgtagattttccgcaaatatgaagcaatgcggcctcttttattttagcagggttcttggtcgtactaacttttaacaggttcctggttcctcttaataacaaaaccgtatcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttagttgtgagactgcgtagtgtgcacgatcggttttaccacttcaatctggtctgtcctttggctgtgatatgtacagagtgtgatagagggaatatctgaattctcccggtgagcattttgcaacggaccagctccggtacaaacgctgttgtgggttcagattataacattctgtctaaggggcgggataaaggtgaaattagggggcatgaaagatgactttataaccttgctcaccccagtgttgtaaaagttcgttttgccttctcgttggtgccatgcctgtccagacaatcaatgtttgcgtcgggaacagttccgggcgcggcgattcaatgggatcagcaagaacagaaatgtgccatcctgacaatgataaacgccatgcttccagccacaatcgtgctctctcttcaacattccacgccatcagaatggcttctttaccgggcttacggcgcatttcgaaaagcgaggttgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaaagttgaacactagttggcgaaaaatcttgtatagattgtcagttaaatgatgcaatatgttttatcataacacattgttttatatgcattagcactaattgcaaaaaattaatttatcattctgtacacatatttcgtacaagtttgctattgttacttcacttaacattgattaacatttttaacagaggcgtagcatgcatcaaaattcagtgactttagattctgcgggagcaatcactcgttactttgcaaaagctaacttgcatactcagcaggaaactctcggggaaattgtgactgagattttgaaagatggacgtaatctgagtcgaaagtcgctttgtgccaaacttctttgccgactggaacacgcgactggggaagaggaacagaaacattataatgcactaattgggttgctttttgaataatgcaacagcctgattatttaacaggttagctatgaagtcgttatgaagacatctgataatgaacgtataaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggtaagaaaataaacagaatacattaaaatttcataagtaagatgagaggttaccatgcttgaagatactacaattcataatgcaataactgataaagcgttagcaagttactttcgcagttcgggtaatttgttagaagaagaatcagcagtgttagggcaggctgtcaccaatttaatgctttcaggcgataatgttaataataaaaatattatcttaagtctgatacactccttggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattgggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatgcaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaattatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcatcgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactccccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaatgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaggcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagagttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcgtcattaacctcttgagcgacagagaggagtggggcattaacgtttatgacggggagagtccccgtcggttgacatttacttaatttgaatatcgacgttatattttttagttttgtttttacgggcgtcgtttcgggtttgcaacactcgcagctcatatttgccagaagcagggagtgagtattgtccgtgactatcgagttctggggaatatctggataaatcaactgaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcagcaatacagccttcctgatgctcttgattttcattggtagtctcctgttcagaatgagtacgatgaactgttataatataacaatccctaacgggagaattccagtggctttcctgcgttcggtaaaatcacgttgcggcatttttgccggggggattacttataaagggggcatggactcaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaagatttacctgcgtggcatccgctacttactggttcgaaagcggcaatgcatggtgaacgtatctctgtgcgtcatatcgcagtgaaagaatcagaagtgattgactggcaggatcatatcttaaataaacctgactgggcgcagtgataaatttaatagatgctgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatcgcttatcagacttcaggtacctcaaagagtgtctttttaccgtgtcttttctgatactcattacaggtgttaatcatttttttggccgcttcttttagcaaagaaagcattaaatcatcataatcaacgtagaatctggttgtttcagtttccgtttttatctcaccgatggcggctatttcggtggttaatttcaatttggcggcatcgatatctttattcgcttgtttaaccgtgttagacagggtggtaaagaaattctgcacagattttaacttgttcttcaattctggaatcagttttccttcaactacgcccgcagcaatagaataggaaatgattaatccaaatggaccggcgacgacaccggctgcggcaccggcatatgcttccttcctgattttatctacctgtgactggaaatagctgcttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgtgaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctattttttagccgggtgatatttttcatttctgctggatgagcgtcgtcgccagaaggccacgtgagcacaagataagagaacgaaaaatcagcagcctatgcagcgacaaatattgatagcctgaatcagtattgatctgctggcaagaacagactactgtatataaaaacagtataacttcaggcagattattatgttgtttatcaagcctgcggatctccgcgaaattgtgacttttccgctatttagcgatcttgttcagtgtggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgctcccgcaggagcgccgaatggattagcgaccgaacagatcacgttttttcgctttaaacggctgggaaatcaccaccagcactgcgacaatcaggtaagcgataaaaataccgagcagccactgcggcatttccagacctaaaaaatcccactgacgctcggcgcaatcgccagaggcgacaaacacttgcggcacccacttatccagcggcagccattccgggaaacgaaccataaaatcacaggtggcaaacggcgaaggatagagctgaagcatggtgtgctcgtaagttaactgcacaccgcggaacgcactatacaaccagataaccatcgctacataacgcagcggagttttcggggcgatcgcgccaatcagcgcagcacccagaacgccgaataacgcgcagcgttcataaatacagagcacgcaaggtttcagtaacatcacatgctggaaccacagcgccgtcagttccagtgccagagcagtaaacgccatcaacagccacgcgccccggccttgtgaacattggttcaaaaatcgcaacataatcatttccctgcaatatgcatagagtgcgcagtttaaaccaattcattcgctgcgccaccaggaggcagcaaaaataggacgcaattggacaattatcgggcgaaaaggcaaaccgggcatttatatgcccggtaagttgttatcaaagcgttgctatccagcccatttgcataaaccattcggttacaggggcaagcgtaaactcgacgcagagcaagccgacgagtgtcaggacgagggtgtaaggcagggccatccacaccatgcggccataagagaggcgaatcaatggcgcgagtgcagaggtcagcaggaacaggaacgcagcctgaccgttcggcgtagcgacggagggcagattggtaccggtattaatggcgaccgccagcagctcgtattgcttcaacgtgatagcgccactttccattgccgctttcgcttcgttgatataaatcgtccccacgaagacgttatccgaaatggatgacagcagaccgttgaaaatatagaacagcgacagctgagcatgttccgatgcctgcaacacaaactgaataattggcgaaaacagttgttggtcgataatcaccgcgactaccgagaaaaacaccgtcaacagtgcggtgaatggcagagattcggtgaaggctttaccgatagcatgctcatcggtgacaccggtcaatgatgttgccagaataatgactgacaaaccaatcaagccaacttccgccagatgcaacgccagcgcagtcaccagccagacgccaataatcgcctggacaatcagacggattttatcctgacgggtacgctggtggcggctttgatcgtcaaactgttgcaacacttcgcggactttctccggcagcgtttcaccgtagccaaaccaacgcagcttctctaccagcaggcaggttaacaggccacaaatcagaaccggaacggtcaccggcgacatgcgcaggaagaaatcgccaaaatgccagccagccgctttagcgatgatcaggttctgtggttcgcccaccatggtcattacgccgcctaatgcggtgccgacaccggcatgcatcatcaggctacgcagaaagccacggaactgttccagaaccactttgtaatgcttgtcgatatgactatcgtcttgcaggtcggtgtcttcggtacgggaagaggctacgcggtgataaataccataaaaaccgactgcaacgctgatcaccaccgccacgacggttaaggcatcgaggaacgcggagaggaacgcagccgccacgcaaaaagagagcgacagcagcattttggagcgaatgcttaacagcaaacgggtaaatatgaacagcaacagctgtttcataaaatagatacccgccaccataaacatcagtaacagcaagacttcaagatttgccgccacctcttcacggacgtgttccgcgctggtcatgccgatgaataccgcttcgatagccaacagaccaccggggagcagcgggtagcatttcagggccatcgccagagtgaaaataaattccgctaccagcaaccagcccgcgacgaaagggctgatgaggaaaattaacgggtttacgattaagaaaatgatgagggcgagtttgtaccagtcgggggactggcccaaaaaattgcgccatagcgcgcggccccaggagatctccatgatggtttcccttaccttacaaataatcaatgatgtttttatgtttaaacgcaaagcttaacggtcaggcaggagtgaggcaagtcttgatagtcaaggggaaagagatgcggaaaatgaagccttgatccctttttcttctttttgtctgctatcagcgtagttagccctctggtatgatgagtccaactttgttttgctgtgttatggaaatctcactatggtcattaaggcgcaaagcccggcgggtttcgcggaagagtacattattgaaagtatctggaataaccgcttccctcccgggactattttgcccgcagaacgtgaactttcagaattaattggcgtaacgcgtactacgttacgtgaagtgttacagcgtctggcacgagatggctggttgaccattcaacatggcaagccgacgaaggtgaataatttctgggaaacttccggtttaaatatccttgaaacactggcgcgactggatcacgaaagtgtgccgcagcttattgataatttgctgtcggtgcgtaccaatatttccactatttttattcgcaccgcgtttcgtcagcatcccgataaagcgcaggaagtgctggctaccgctaatgaagtggccgatcacgccgatgcctttgccgagctggattacaacatattccgcggcctggcgtttgcttccggcaacccgatttacggtctgattcttaacgggatgaaagggctgtatacgcgtattggtcgtcactatttcgccaatccggaagcgcgcagtctggcgctgggcttctaccacaaactgtcggcgttgtgcagtgaaggcgcgcacgatcaggtgtacgaaacagtgcgtcgctatgggcatgagagtggcgagatttggcaccggatgcagaaaaatctgccgggtgatttagccattcaggggcgataatcccttccgtttaaagagcaaacccctcaaacgaggggttttttgttgtttttacagatttcccattcttggcgggcaacgttccagcaactcgatgctgccgtcttcgttttgctgttcgagcatcacatcaaatccccacaggcgatgcacatgcttcaggacttctttgcgcccccgatccagcggtgcgcgattatgtggaatataacgcagcgtcagcgaacggtcgccgcgcaaatccacgttccagatctgaatattcggctccagattacttaagttatattgcgacgataaccggttacggatctcccgataaccttcttcattatgaatagcggaaatctccagataattatgccgatcgtcatccagcacggtgaagaagcggaaatcacgcatcactttcggtgacaggaactggctgataaaactctcatctttgaaatcacgcatcgcgaaatgcagcgtttccagccagtcggaaccggcgatatccgggaaccagtatttgtcttcttccgttggcgactgacaaatccgtttaatatcctggaacatggcgaacccgagggcatacgggttgatgccgctgtaccacgggctgttataggggggctggaagaccacattggtgtggctgtgcaaaaactccagcataaaacgttccgttactttcccttcatcatacagatggttaaggatggtgtagtgccagaaggtcgcccagccttcgttcatcacctgagtctgtttttgcggataaaaatactggctcaccttacgcacaatacgcaggatttcacgctgccatgattccagcagtggcgcatttttctccataaaatagagcaggttttcttgtggttcggacggatagcggcgcgcttcagcaaccgttttctcttcctcgcgcttcggcagggtacgccagagcatattgacctgactttgcagatactcttcgcgacttttctgccgggctttctcttcttgcagcgagattttttgcgggcgtttgtaccggtccacgccgtagttcatcagcgcgtggcacgagtccagaagccgttctacttcatcaacgccataacgctcttcgcactcggtaatatatttacgggcaaaaatcagataatcgacaatcgaactggcgtcggtccagctacggaataagtaattgtttttgaagaaagagttatgcccatagcaggcatgagccatcaccagcgcttgcatggtaatggtgttctcttccatcaggtaagcgatacacgggttagagttaatgacgatttcataggccagtccttgctgaccgtgcttatacagccgttcagtctcgataaactttttaccgaatgaccagtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaaacgtgtggtgtccttattcatagaatcgatcgtcgccatacgcgcacctcattgttgtcggcgctctctgtgtggagcacctcatttcaagcatagaacacctgttaaaaaccgcgtcgccggagaatttttttctttgcgatttcttattatcagagtgccactaatccgcttctgaacggaattttatgctggataaaaagggcgttcagcaggagatactaaagacgccatattgccgcagagtcagggagatgtgagccagctcaccataaaaaagccgcatgttgaataatattttcaactgagttatcaagatgtgattagattattattcttttactgtatctaccgttatcggagtggctatgcgagttgtcatactgggaagtggtgtggtaggcgttgccagcgcctggtacttaaatcaggcaggacatgaggtcaccgtcattgatcgggagccgggggccgccctggaaaccagtgccgcgaatgccgggcaaatctcccccggatatgctgcaccgtgggcggcaccaggtgtgcctttaaaagcgattaaatggatgttccagcgccatgcgccgctggcggttcgtctcgacggtacgcagttccagttgaaatggatgtggcaaatgttacgtaactgcgacaccagccactacatggaaaacaaagggcggatggtgcgtctggcggaatacagccgtgattgcctgaaagcattgcgcgccgaaaccaatattcagtatgaagggcgtcagggtgggacgctgcaactgttccgtaccgaacaacagtatgaaaatgcgacccgcgatatcgccgtgctggaagatgccggcgtaccgtatcagctgctggaatccagccgcctggcggaagtggagcccgcgctggcagaagtggcgcacaaactgacgggcggcctgcagttacccaatgatgaaaccggagactgtcagctatttacccagaatctggcgcggatggcggagcaggcgggggttaaattccgctttaatacgcccgttgaccaactgctttgcgacggcgagcaaatctacggcgtgaagtgtggcgatgaagtgattaaggccgatgcgtatgtgatggcgtttggttcttactcgacggcgatgctcaaaggcattgttgatattccggtgtatccgctgaaaggctactcgctgaccattccaattgcgcaggaagatggtgcgccggtatccaccattcttgatgaaacctacaaaatcgccattacccgtttcgataaccgcattcgtgttggcggaatggcggagattgttggttttaataccgagctgttgcaaccgcgtcgtgaaacgctggagatggtggttcgcgatctctatccacgcggcggtcatgtcgagcaggcgactttctggactggtctgcgcccgatgacgccagacggcacgccggttgtcgggcgtacacgctttaaaaatctgtggctgaataccggtcacggcacgctcggctggacgatggcttgcggttccggtcagttgttaagcgatctgctctctggtcgcacgccagcgatcccatatgaggatctaagcgtagcgcgctacagccgtggatttacgccatcacgtccgggccatttacatggcgcacacagctaaggaaacgagatgacccgtccgatacaggccagcctcgatctgcaggcattaaaacagaatctgtccattgtccgccaggccgcgacgcacgcgcgcgtctggtcggtggtaaaagcgaacgcttacgggcatggtattgagcgtatctggagcgcgatcggggccaccgatggctttgcattgcttaacctggaagaggcaataacgttacgtgagcgcggctggaaaggaccgatcctgatgctggaaggatttttccatgctcaggatctggagatttatgaccagcaccgcctgaccacctgcgtacacagcaactggcagctcaaagcactgcaaaatgcgcggctaaaagcaccgttggatatttatcttaaagtgaacagtgggatgaatcggttgggcttccagcccgatcgcgtgcttaccgtctggcagcagttgcgggcaatggcgaatgttggcgaaatgaccctgatgtcgcattttgccgaagcggaacatcctgatggaatttccggcgcgatggcgcgtattgagcaggcggcggaggggctggagtgtcggcgttcgttgtccaattcggcggcgactctgtggcacccggaagcgcattttgactgggttcggcctggcattattttgtatggcgcttcgccgtccggtcagtggcgtgatatcgccaataccggattacgtccggtgatgacgctaagcagtgagattattggtgtccagacgctaaaagcgggcgagcgtgtgggctacggcggtcgctatactgcgcgcgatgaacagcgaatcggcattgtcgccgcagggtacgccgacggttatccgcgccacgcgcctaccggtacccctgttttagtggacggcgtgcgcaccatgacggtggggaccgtctcgatggatatgctagcggtcgatttaacgccttgcccgcaggcgggtattggtacgccggttgagctgtggggcaaggagatcaaaattgatgatgtcgccgccgctgccggaacggtgggctatgagttgatgtgcgcgctggcgctacgcgtcccggttgtgacggtgtaacttgttgtaagccggatcggaggcaacgtcttctgggtgcaaaaaaatcatccatccggctggtcagcaactgtagttgttaatgtgacagagccattgcccatgatagtgtccattaaaaggatggacactatttccccggaacctgaactcaccgcacaggcgttctacataaaacgcttacgcttcattgttgactcgaactcgacttcagataaatcacgctttacccttgatggagcctgtacatagatttgtgtaattgcctgattttgatatgttcaattcaacatcaaatgaaggttaaattatggacgacaaacaattgcaggctcaggctgcgttcagcaaagcatcgcaaccggcgatagatgcttcattaaatttaagattcagcttcctcttcagccacccgtacgccaatcttcaacacttcattatcttctttctcggccaccgtccagatcatcccggcaaactctacctggtcaccgacaaccggtgccgcgcctaacaactgctggacaatttcacccagcgtttgctgcttatcacgatattctcgcccgtcttccaggccatatatcagcgcaacatcagcatatttggcgctggcttcgagaatgaagtcaccaaagaagcgttgatccagcgcgaccggcggcgactggctgaacagtttaccgagcgccggaagatcgcgttcccgaccaattacacacaacacatcgccttcgcgcagtcgggtgctgccggtaggatgaagcaactggttatcacgaaacagtgccgcaatacgcgtctcttttggcatatgcaaatcgcgcagtgccgcgcccacgcaccatttatcggcactcaattgataaacaaactgctcccacggattttccggatgaatatccaggccaacgcgtgacaccggacgtcccactggcggaaccaccactttggcttttttagccgcccacgagagtgatgttccctgcaagagcagtgaaaccagaaccacaaagaaggcgacattaaagaacagacgtgcattctccagccccgccatcatcgggaacacggccaggatgattggcaccgcgccgcgtaatcctacccagctgataaacacgcgctcacgcagattgaaaccgcggaaggggagcaatccagcaaataccgaaaggggacgggcgaagaatatcatccatgcggacaaaatgagcgccggaatggcaataggcagcagatcgcttgggttaaccaacagccccagcaccaggaacatggcgatttgcgccagccaggcgaggccgtcgaaattttgcaggatgccgtagcggttgcgaatagggcgattacccagcagaaaaccgcacagatacaccgccagaataccgctaccttccagcgcagtagttaatgagaaaatcagaataccgccacttaatgccagcaatggatataatccggcgggcagggcgatgcggttgatcatttgcagtagtaaataaccgccgccaagacctattacaatgcccagaccaaattgttgcagaatatcgacaatgaacatccagctaatattgctctcatgatgctggatcatcgcaattagggtaatcgtcagaaagaccgccattggatcattactgccggattcaatttccagcgtcgagccaacacgttcgttaagccccttaccacccagcagagaaaagaccgctgcagcatcggtagagccgacgatagcgccgattaataagccttcaatcaaatcaagattaaacagccacgccgccatcatgccggttaaaccagaggtgataagcacgcccagcgtcgccagcgacagtgccggtcctaacgccacacgaaaggaactggcctgagtgcgcatcccgccgtcgagcaaaataatcgccagtgccaggttacttaccatgtaggcgaaggggtaattatcaaacgggataccgccgacgccatcgactcctgccagcatgccgatcgccagaaaaataaccagaataggaatgccaagacgggaagaaaatgaactaagtaatatactgctggtgacaaggatggatcctaagatgaaaaggctaattattgttgtggcatccaacggtcggttactcctgattacgctgtctcttatataaaccctaccatattagcggcagagacagcgttttacttagccctgaagcgtgatttttttacattttaagaacaggatgaccgctaatcgtcaactgagtgccttcccgggtgttattcagaatggcatgtgcgcccaacggcagcgtaaccgtgcgttgttcatgaccaaaatcgaggccggtaatgagtggaatcgacaggcgggaacgcaaaaacgcgtacactgactccaggttgtaacctgcgtcataatcattgggcgtgctgccgctaaagctaccgagaataatcgccttctgacgtggcaaaattcccgcatgatagagctgcaacagcatacgttcgacccggaaagggtgctcgttaatatcttccagcaccagaataccgttctcaatttttggcatccacggtgtaccgatcagtgaaatcagcatcgcaagattgcctccccacaacgtgccttcggcccgacatgtcgggccttccccttgccattcaatggtgaaggtttcattgcgtaacgccagccagaaatggtgctcggtaaaggcgttcagttcatccgcgccaaagtttgctaccagcatggggccgctaaaggtgatgacattgccatgcgccagaagaccgcactgaatggcggtaaaatcgctatgtccgcaaatgagcaacgggtcatgttgttggcgagccaccagtgcctgccagtcaatatctgccagtaaacgactggcaccgtaaccgccgcgtacagccagcacgatggtgttgggggtagtcagtctggcaagggaattgagatcttccagacgctctgtttccgtacccgcaaaacgctcacaacgacgggcaataacctcgacgttattgacttgatgccccgcgtcggtaaggcgctggataccacgcagcgcggcgtgctgtttaatgcagtaacccgatggggcaattaagtgaaacagagacatggcaattccttgctgacaacagaaacgaaatgtatatcatgccgcttaggtgtgccgttgtcacctcaacggcgattccaggctataaggatagaagaagtgaaattgagatggtttgcctttttgattgtgttattagcgggttgttcatcaaagcatgactatacgaacccgccgtggaacgcgaaagttccggtgcaacgtgcgatgcagtggatgccaataagccagaaagccggtgcagcctggggcgtcgatccacaattgatcacggcgattatcgctatcgaatcgggtggtaatccgaacgcggtgagtaaatcgaatgccattggtttgatgcagttaaaagcttcaacctccggacgtgatgtttatcgccgtatgggctggagtggtgagccgacgaccagcgagctgaaaaatccagagcgtaatatttcaatgggggcggcttacctgaatattctggaaaccggcccgctggcaggcattgaagatccgaaggtactgcaatatgcgctggtggtgtcatacgctaacggggcaggtgcgctgctacggactttctcgtcagatcggaaaaaggcgatcagcaaaatcaacgatttggatgctgacgagttcctcgaacacgtagcgcgaaatcaccctgcgccgcaggctccgcgctatatctacaaacttgagcaggcactggacgcgatgtaaatcagtcgcgcactttgtccgctttttcccgggcttctcgctcgagagagaaaataatccgctgtaattgccgctccaccgtcgggctgacgttaagaaaacggaagctcagacggggagtggtgatggtttcattcttgccatcaatcactttgcgctcgctgatggagattaactgggcgtcaaagtgaaaaacaccccattgccccatgttgacttcaatctgagcgaagcgcatgccttcttgtaattcggcaggctttgctgtttccagtaatgcgcccatgccgcctaacgacaaatcatacaggcggaaacgtaacgtactgttatccgccagtttggtctggcaaaaataaggcggatggagtggggcggagatgcggaaatatcggcgtcgttgtacaaaccataaggtgggaggcggtacggtaataaatgccggaagctgcaagtattcactctgctgtagttgttcaacagtaaactcgactttcgcaccctgagtttcggcggtaatggtaatgtgctgtgcctttagcacggcgatgttgtcttcggcttgactgccgaaatccagcaccagtttatccggggttattgccagtaatttgctgatcagctgcccgccattccaactgagacgcaaaggaattgcggctttgtgcaaatcgcgtaacacgcccaggacggctaacggattttgtttcaggaactgctcatggtaatgactcacgcggaaaaactcctgactgacaaactgtctttggtttatcggtcacagttaacaaaacttaatacaaatgcgtgaatattttttacatgttgttcttaaatcagccgacatacgcccagcatcgatcccgcccttgcctatacttagagcgttgatgtaagcatttcttgcgtccgattcatcgaaacgagggcctgaacatgggaattattgcctggattatttttgacctgatagccggcattatcgccaagctaatcatgccggggcgtgatggtggtggatttttcctgacctgtattctcgggatagtcggtgcggtggtcggcggctggctggcgaccatgtttggcattggcggctccatcagtggttttaatctgcacagcttcctggtggcggtggtgggagctattctcgttctgggcatattccgcctcctgcgaagagaataagattttcataaggcggatagcgatacagatgccgctatccgctttcacatcagaacgtatactcgacacctgctttacgggtgaaaaaaatcaatatagcacttcgatatccgataaagtcggttcccggtaacaacaacagaatccttttttaattattgtttcgttgtttttggtgtgattcagaaaataaatattttagacagtagccagtcaggcgttaaaaatggggcggatagtgaggcggttttggctgcgcttattgaacatttagaattgatcaatccttctggcagattaagccaaaatacccgttcggcaatgcttcagttacgcgaagaggaatggtctgaattctttttttggttgctaaattctctggagtgtctggattatgtgattattaatttaactccagaaagcaaaaaaacgttgatgagtgaacaccgtaacaatattcaggtagcaattgatgctttatatagccaacgtcggcgtaaatcgccgggtgatgaaagtgaaacacttacccgtagaaatgacgctatcttcggcaaccacgtatggcaaacatttgcgcaatacttcccgccaggacttgaaaaaccgtctgtgtagaaaaaaccatagctatggtgttatctgccgacaacgccatccggagaagccgaatgacgttgtcggagtaagcgctggttaaggtgtgggttgtgcctctttggttgagggttgcgtcgttgctgacttaacggtcggacgcgtcgccggaacattgtcacacggttgctctttcgggcagatcaaatccagcattttcagcgtcacgccattggtccagccaaagccatcctgtaatggatattcgccaccgccgccccccgttccggtggtgctgacatcatatttttccaccagctttttctcccggtcataggtgtgctgaacattggtcaggaagtgccagctaatgtccatcgccacctctttttgcccgtagttttgtaatccttctgtcgcgacccactgtaacggtgcccagccatttggcgcatcccattgttgcccacttttcaccgacgtggtgttcaggccgccgggttgcagcagatgtgttttcgtcgccgtcgccattttgttggcgcgatctttcgctgccgcattgacgtacagcgggaacagggcggccgcggttaactgattgcgcactttatgacttttcaggtcgtaatcggcataccagccttgttgatcgttccacaggtatttttcgatccctttttgacgggcatttgccagcgtttcgtactggtttgccatcgcgttatctccggcagctttgctggcgcgggcgaggattttttccattttaaacatcaggctgttcagatcgaccggtacgatgctggtggtgcgtaaggtatttaactgctgcgggttgtccatccagcgcgagctgaaatcccagccagacgcagcggcagagcgcaggtcgcggtaaatttcagtggcaggtcgattcggattgcttttggcggtggcaatatcttccacccatgactctggtcgtggcgtatcgcgatcgtcccagtagcggttgagaagggtaccatcctgaagtttgacaacgcgtttttcctgttgtccggcttgcaggttttcaacaccgtccatccagtaagcatattctttttgcatttgcggcaggtattgcttcaacgcggcatcgccttcatgctgcgccagtaactctaccatcagggcaaagaagggcggttgcgagcggcttaaatagtaactgcggttgccgttgggaatatgaccgtaagtgtctatttcatgagcaaaattggccaccatatccgcgactttatcccagtgaccgctttcggcaagtcctaacatggtgaagtaactgtcccagtaatatacctcgcgaaagcgtccgcccggcacgacataaggttccggcagcggtaacagagaatcccatttttcggtgttttcggtagaacgcgttaataccggccaaagtccgtcaatatgttcgcgcagtgactgcccctctggcggaacatatttctcgccttctttcggcagggtgaaattgacgttaacgaaatggcgcagatcaaatccgctctggttttgctgcatccgataatcagcaaggatcatcagcggatcgctgttcggcacggcatcggcaaaggttttttggtccggaaaaagtttggcgttttgcacatcattaaacagcggccctaataaaatatcaggcggctgtggtgttaccggtgtttcttctgcctgcaccgatagcgcagcgaaacacaaaaagatacaggctggaattaacgccattttttgcgggcgagaaggtgcgggggatttcatcaatcattctcctttggcgaaaccgaataaaacggtattcaagtatcagaaaaccttagttcaggatcgcactagctgcatgatcgaaatctcattctgcgaactgtcaggcattttagaaaagggaattaaagggataaataacggcgaaatagagtgatcaaataacgtctgtttattagccagccagcggcgttgggttcgtgattagcgaagaaaaatcatcataaattggtgaaaaatataacaggtagttaaaaaccattagtgctgagtaaattgccggatgacatcagaacgatgccatccgaacagtggcttaaccctgacggttgaaacgttgcgttttaacgtccagcgttagcgtttcttctggttgtatcgcatacagtttctcaccctgctggcaaatccagccaatccccagttcacgggcgattagggcgctgtgggataccggacttccggcgctaaggcagataccttttacaaccgccggatccagttgcagtactgtggaaggataaatgttctccgccagtagaatagttggcgagttaaactgcgggagttcttctttcgtttgggtcaggtggaccagggtgcgatgcagaagatcgtccacatcaatatagcgagcttgtagatattcatcatccagttgctggtattgctggctaagttctttaagaacttgctgccaggcatattctgccgtgcaatgttcatgctgaaggagttcgcttgccgccgccagcagttccggatcatctaacagtgtatggtgaccagaaaagattgcggcaatatcgtcaagcccgctggcttctgctttcgctgttaacgtcatcagatctaataacgtgaagtcaatagcctggcgtaatcgatcttgttcttcttccacggtcagggttgattttgcctgtaccgtacataaaactggttgataataaaaggctttacccgaaacaggcggaacgggacgcagagtaggtggagcgacttcctccgtttcaccaaagttatcttcagccagctgacggaaagcgatcagtgcctcttcagcttctggccctttcgcaatcaggcgcagcgtatcgttatagcgaacttgtagtaacgcaatctggttaatactctctggtgtgacgcatttgccgtttttttccagcaacatatcggcattaaatgtcgataaggtataaaccagccgggaggccggacgtacatgcaggccgttacggttttttatgaccaccgccagagaacgggcttcttcatcgtacgcaggacatgtgtcagagatttcagtgtcggaggacggtaaacccagttgttcacgtttggcttccagcgcatgcatggcgtcaaagataactttgtcgatatccgcccccgaggccgcgctgaccgttgctgccagtgtaccttcgaccaacggcgcagcacacaaacgtacttttgcggcgatctcgggagccagcaattccagcgcagtttcagcactcaataatgcgctacccatatccatcatgaccagcacatggtcggcatcagcaacagattcgatggcctccatcactttgacggcatcggtaccaatgggattttgtggatcgtcaattcccgcggcaatggcgattttacaactatcactcattaacatctgacgggctaattcaccgacaccttctcccagtcggctgctatgtgaaactatgaccaggtttaccatcaccaattccttactcttttgcggctaacgccaacatttgcatcataaacatcaccgaggtcgcgccgggatcctggtgaccaatactgcgttcaccgagataactggcgcggcctttgcgggcttgcatcgtaatcgtactttgtgcagcggattcggcgatgctactggcagcttcgagcgccaccggaacagagagattttgctcgctggactgacgtaacgattccaccaccggcacccacacatcacacatggttttatcgccaggttcggctttcccgcgactgattacgccgtccgcgccatcgcggaacatctgataaagctcttccagtgtcaggctttgccgtgcctgggtcgcctgtgcggcgcggataaagaaggtaccgaacagcggaccactggcaccaccgacgctggaaagcagcgtcataccggtattcttgagaatgaaaccgatatctttatctgcgatagcagggagtttttccaccactttgctaaagcctcggttcatatttagcccgtggtcagcatcgccaatttcgcgatccagtccggtaagatactcgctctcggtgctgaaaatatcgccacaacgagtgagccagttaacaatttgagttctgctcagtgacattgctttctccttatttaccccagttaagggccggggtgtggaccggggcgtcccagagtgccagcgtttcgtcatcaactttcagtaaggtgattgagaaaccggtcatatccagtgaggtgcagtacgcgccaattaaattacgttcgatagtcaatcccgcttgctggcaacgtgtggtcaggcggttatagacgccgtacagctcagaaagcggagttgcgccaagattgttaaccagcgcaatcacccgatcgccagactggagcggttgtttggtttgttgttcttcctgccaactgccttgttgataatcccagaaacgcaaagtgcgatggtatgagccatttaccagcagggtgtcgaacatttcatcgacggtttgatcaagggaagagaaggggcggcggtcaatacccggctcaccatgaatgccgacgccaaactccatctcattatccgccagggtaaaagaaggtttgcccgcggcaggaacggtacaggcaccgagagcgatacctattgagtggccttgattattcagcttacgccccagttccgcacaggcgtccagtgagtcgccacgctccgccgctgcgcctacgagtttttcaattaatacggtgttggcaacgccgcgtcgcccggcagtataaagactgtcttttaccgcaacgtcgtcatcaatgaccacagtggtcacttttacgccgctatcgtgcagtaactcggtcgctgtttcaaagttaagaatatcgccggtgtaatttttgataatcaacagtacaccttcgccgccatcaacttgcatggcgcattcaaagattttatcgggcgtcggtgaggtgaaaatttcgcccggacaggcccccgaaagcatcccctgaccgatataaccacagtgcatcggctcgtgtccgctgccgccacccgacagcagggcgacttttcctgcaacaggggcatcagctcgggtgacatacaccggatcctgatgcagtgtcagcgatggatgcgctttcgccagtcctgccagttgttcgtccagtacgtcttgcacatcattgatcaattttttcattattttgctccagcaattacggtagggcatggatgatgttcaacgacacggcgaccactgactgccgatgaatccattgtgcatcaggcaagggaaaagaaaattagcccaaattatgtttcatagtgaaacatatgctttaatgaatgttccatattgaaacttttacgtgtattaatacttaaaattgcgagccggaacaccttttgtcataagggatgcgggatatgagtggcgcttttaacaacgatggtcggggcatatctcccttaattgcaacctcctgggagcgatgcaataagctgatgaaacgggagacatggaacgtaccacatcaggcccagggcgtgacatttgcttctatttatcggcgtaagaaagcgatgctgacgctcgggcaggctgcgctggaagatgcctgggaatatatggcaccgcgagagtgtgcgctgtttatcctcgatgaaaccgcctgcattctcagccgtaatggcgatccgcaaaccttgcagcagctaagtgcactgggattcaatgacggcacgtattgcgccgagggaattattggtacttgtgcgctatcgttagcggctatctctggtcaggccgtgaaaacgatggccgatcaacatttcaaacaggtactctggaactgggccttttgtgcaacgccgttgtttgacagcaagggccgattgacgggaacaatagcgctggcgtgtccggttgagcaaactaccgcagctgatttgccgttgacgttggcaatcgcccgcgaggtcggaaatttactgctgacggacagtttgctcgctgaaactaaccgtcatttaaatcaacttaatgccctgttagaaagtatggatgatggcgtgattagctgggacgagcagggtaatttgcaatttattaatgcccaggcggcgcgggtcttgcgccttgacgcgacggcaagtcagggacgggcaatcactgaactcttaacgttacccgccgtattgcaacaagcaataaaacaggcacatccgctcaaacacgtagaagcaacctttgaaagccagcaccagtttattgatgcggtgataacccttaaaccgataatagaaacgcagggaaccagctttattttgttgctccatcctgtggaacagatgcggcagttgatgaccagtcaattaggaaaagtcagccataccttcgctcatatgccacaggacgatccgcaaacccgccgcttgattcattttggtcgccaggcggcgcgcagtagctttcctgtcctgctttgtggagaagagggcgtgggcaaggcactgctaagtcaggcaattcataatgaaagcgagcgtgctgcaggtccttatatcgccgtcaattgtgagttatatggtgatgctgcgctggcggaagaatttattggtggcgatcgcacggacaatgaaaatggccgtctgagtcggctggaactggcacacggcggcacgctgtttcttgaaaagattgaatatctggcggtggagttacagtctgctttgcttcaggttatcaagcagggggttatcacgcgactggatgcgcggcgtttaataccaattgatgtcaaagtgattgcaacaacgaccgcggacctcgcaatgctggtggaacaaaatcgttttagtcgccagctgtattacgcgctgcatgcatttgaaattaccatcccgcctctgcgtatgcggcgtggcagcattccggcgctggtgaataacaaattacgcagtcttgaaaaacgcttctctacgcggctgaaaattgatgacgatgccctcgctcgcctggtttcttgtgcatggccaggcaacgattttgaactttacagcgtcatcgagaatcttgctctgagtagtgataacgggcgcattcgcgtcagtgatttgccggaacatctgtttaccgagcaggcgacagatgatgtcagcgccacccgcctttccaccagtctgtcatttgcggaagttgaaaaagaggcaattattaacgcagcccaggtcacaggcggtcgcattcaggaaatgtcggctttacttgggatcggccgcactacgctgtggcggaaaatgaagcaacatggcattgatgcagggcagtttaagcgccgggtatgaaagacagaaacgatttctgatacatcagagtgatctgtatttcattccggcgcacgctaacaattttcagcatcgtttaagggcttgtctatcccgcacttaaaagctgaagcgatatcctccgttgacttgcttctgatcaaagaggttaccctgcgtgtaatccgcttcgagatagaatgtgtgctgtttgttatactgtgcactgactcccacgccgttattccagccattacctttgaaactgtacttctcccgggagttgttcaacagatattcggtatcccctgaaaactcgcggatagcgccagtcttcacatagacattcagctggctgttgcctgcggtgatgtcataccccagtatcatgctggcacgccccagcagcgattcgtagtgattcagatgtatattgaggccattactcgccttcatagtcatctcattctggtggctgtatgtaagctgggtttgcggctctatatagaacccataaccagtaggggacaggttgaacctctgcccggcttccagggagatgctcattccattcgcagtgccgttggcgttaacgccgttgttctgactgtccagtacgtggaaactatttttctggcgcgatgcttttataacgagatcgctgtaaaaaccgttttgtgccatgtaactggcgtacattcccatgtagtctgaacgtgcggtaccgtcgcctccgctatagtccggcgatgcatgtgttgagccaatatacagaccgacatacaacggcattacatcagagagacgtttatccccaccaaactggataccgctgtaacccatgtcaaagccgctcagtttgccactggcaaaggagtccaggcttcccccataactgcgcaaccagatattaccgtctttactctgatttcgcaggtcacccatccgttgcatcagcgtacggttttcaacatagttcaataagtaaccgacattgagataattgccgccagcatctgcggtcgtggtgggtttaggcgtgggagcgggttcaggcgtaggatcggggttgactatgggaggctgagcgggagctggtgtgggttcaggattaggagtcggttccggaactgtcccggaagcgtaaagctcccagttagtgccatttttacgcacatcgtacagatatccccccaactcaacctgagaagacgcgctgaacgaggccgcgccgtcagtggtttttaccactgtcagaacttcatttcccgttgtggcctcgctgccctggttgcggatagccaatacgtgattaccagcactactcccgctgatattcaataaatcccctttattattaacgccattaccctcgccaacaacatcagcacgcataataaaggtactgttaccgctcaggttctctacgtttaatgtggcaaatgtgccggcagttgacccgtggctggcaaaatcgacagttgaatggctcagcgccagcgtgtcgagattagaattacttgttacgttccagacgctgttattcattgcaacgtccagttttccgccattgacattatcgctgagggaggaacctgtccaaaccgacccagggtgcatatccagattgattagcccacctttggaaagaacgctaccgttgataagcatacgacccgaggcgttgatgcggctggcggcataaccatcgtcatgttgcgttgcgatggccatctggtcgggtgtactcatatcaatgaccagatcgctcgtgaggtcgatctggctgttggtcatggcataaattcccctggctcctgccgcgccggtgatagccaaactgtctccggttattctaccgccgctgagagcccacaaacccagcgccagactgccattacgatcaactgtaatatcggtattttgcatgttgacaacagccgttgccgtctgggccgaggcaccataagaaccgccggaaaagatgctgtttcgttgcgctgccgtgccagtaaaattgattatcgcgtctgaaccactggtgacgaggccaccgccctgcgcggaagaaatatggctatctgcaccgatagtggttgtaccaccacgaacttcgacgccattggccgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatcgattgtcaggtctgtagccgtaaaacgcgcagcaccattggcgttattgccgttgagaccaccgatataaacacctgtacttccatcggtcgtgattttacttccgcttccaagatcgacactggtgccatagtcattgatggttaggcctataccgttcgagttttcaatggtgaattgagtggctgttagtgttgagctatgcccaataatgatgccgtcatcgttactcttaatggtgctgcctgtgcctaagtcagcatgggtatagtcaccaattaagttaatgccgatggcagaggtttgaccaacaacatctactgtgagtcggttagctgtcagggagctgtttttgccctgaataatgattccttttgcatatccagaggcgtcgttgacattgacggtgacatcattacccaggttgatattgccaggcgtgtttcctgctggggtcattacaccatagaggtttcctgatggatcggcggtatctcctgtaattctgtcaccatcattaatagtaatattggtgccatattgacttcctgtatcagcagctatcagcaggggggaaaagataattgcattcaaaccaatagcgccaaattttatcagttgaattgagggcgaacggatttttaattcagcgagacgatctgctttggtattcccattgtgttgtttgatgcccataccactcctatatagtacccagactatgggtctatggattttgtcattttgtttaaatcaatgaataatatcctcttatcatcatgatatttgtatggtgcaatcatgatgagcttctcagagaataattctctattaccgggcaaaatcaggaacacaggaattaatatatatttaacatcccccttacaaaggtgagtttatatcgagttattccctaagttgtcgttacttattccaattcgttactataaatatggcaaaaatattacaacaaacagcggttaaaaaatttggtgaagattttttgtaataatcctaattagttatgggaatttcgcttgatgtatctgcataacaaaaacaatatgcgccatttttgcattactaataagaaaaagcaaaaaacatcgatattcatttttggtcaatgggttttctggcctatcgttgttattgtgctactggttatcattttcatcttgccagcatattggagcgtgatcaattttgatcagctgtgaagggggctgatgtgtagtgatacaaaaacttacgttatatcactgctaatgagatatccggcatctgaacacttatgtctttaattattctcgtggttcactataggcaataagcacaaaagtgtaggatgttacaagaatgattaggactcggtgaaatgaaaaatccacgcaattgcgtggattttatatacttttgcgctcttcatgagatttagcgaaacctcatgagacaataaattaattagacgttgaaaaggaagttcatcacatcgccatctttcacgatgtaatctttaccttctgcacgcattttgcctgcttctttcgcgccttgttcacctttgtaagtgatgaaatcttcaaacgagatggtttgtgcacggataaagcctttttcaaaatcagtatggattttgcccgctgcctgcggcgcggttgctccaaccggaatggtccatgcacgcacttctttcaccccagcggtgaagtaagtttgcaggttcagcagtttataaccggcacggatcacacggttcaggcccggctcttccagcccaagctcctgcataaactcgtcacgttcttcgtcgtccagttcggcaatgtctgcttcaacagcagcacaaaccggaaccacaacagaaccttctttcgccgcgatttcacgcacctggtcaagatatgggttgttttcaaaaccgtcttcgttgacgttggcgatgtacattgttggtttcagcgtcaggaagctcaggtaacgaatagccgctttctcttcagcgcttaaatccagcgcgcgcagcatacctgcattttccaactggggcaggcatttttccaggaccgccagctcagctttcgcgtctttatcgccacctttggctttcttctgtacgcgatgaatcgcacgttcgcaggtgtcgaggtctgccagcgccagttcggtgttgataacttcaatatcgtcagccgggttaactttgccggaaacgtgaatgatgttgtcattttcaaagcagcgaacaacgtgaccgatcgcttcggtttcacggatgttggtcaggaactggttacccagaccttcgcctttcgatgcgccttttaccagaccggcgatatcgacaaattccatggtcgtgggaagcgtacgctgcggttttacgatttcagccagttgatccaggcgaggatcaggcattggtacgacgcctgtgttcggctcaatggtgcagaatggaaagttggccgcttcaataccggctttggtcagcgcgttgaacagggtagatttcccgacgttgggcaaaccgacgataccgcatttgaatcccatgatttaaatcaccttaatatcttaataatcaacctgttattgctaacagattgcagaaatggaaataactttgcctattatacacggcactcggcaaaaatgccgcagacaacgacttattgcgctttaaaggcgtgcaatcggttcgttgctttggtcaagccatctgtaaaccacatttcagtacaacgcgccgcttcgtcaatggcttcatcaattaacttctgttcactaacaggcggtttgcctaacacaaaaccgacaactttatttttatcgcccggatgaccgattccgatgcgtaaacggtgaaagttagggttattacccaatttactgatgatgtctttcagtccattgtgaccaccatggccaccgcccaatttaaatttggcgacgccaggaggcagatccagttcgtcgtgggccaccagaatttcgtccggattaatgcggaaaaaactggccatcgccgcaacggctttgccgctgagattcataaatgtagtcgggactaacaggcggacatcttcgcctccaagagtgactcgcgaagtataaccaaagaatttagcctcttcgcgcagcggagcgcgcaaacgctctgccagtaagtcaacgaaccaggcaccagcattatgtcgcgttgcggcgtattcagcaccggggttcgccaggccgacaatcaatttaatcgtcacgtttttttgtcctgagtgtgtacataactggcgcgtagtttactggttgcggccccgcttgacaaaaaactgcgtatcaaatgcagataacgtaataattgcctgagtggactattagaaagtcaaggtgttcaggcgtttatttgtaaagttttgttgaaataagggttgtaattgtgatcacgcccgcacataacccactgggtgttgtctatactttacacataaggaagaggggtattccctgttacaacccagaaagttccggaggtgacatatgaaacgcaaaaacgcttcgttactcggtaacgtgctcatggggttgggtctggtggtaatggtggtcggcgtggggtattcaatcctcaaccagttaccacagtttaatatgccccagtatttcgcacatggtgcagtgctaagtattttcgtcggtgccattctctggctggcgggtgcccgtgttggcgggcatgaacaggtgtgcgaccgttactggtgggttcgccactatgacaaacgttgccgccgtagcgataatcgccgtcatagctaacaaataatgcagtttgctgaccagtcagtttgcgctgactggtcaatctcgtacttataaatccgccatcgccgcgcgacgattcgggaagaacgccaggcgtcccgggatcggttgaatgccagcgcgagccatagtgcgcagtggctggaattccacgttgcacacgcgcagttcacatccctcgggcagacgcttcacaaaacgctggaacgcatcaagaccaccagcatcaagtaccggaacggcatcccacttcagaatcacaatccgtttgccttcaagacgtgactccaggtccgtgaataagccttcagcagcagcaaaaaacagcgggccaataacgcgcagaaccaggacatcgtctggaacatctacgactaccggtgccaggcgagtcatacgtgcgatacgacgcataaacagcagcgatgccagcacgatccccacgctgatggcaataaccatatcaaacaacacggtcagcgacatgcacagcagcatgacgatgatgtcatctttcggcgcatgacgcagcaagtcgaccactttgtgcgcttcactcatgttccacgccaccatcaacagcagggctgccatggcggaaagcggcagccaggagagcagcggtgccagtaccagcagggcaagaataaccagaatagagtggatcaccgccgagataggggacgttgccccggcacggacgttagcggcagaacgcgcgatggcagctgtagcggtaataccaccaaagaacggagcgataatattccccagtccctgtccaaccagttcgctgttcgccttgtgtttcgtcccggtcataccatccagcaccacggcgcagagcagagattcgattgcgccgagcattgccattgagaatgccgcaggcagcagtgtgcgaatagaatcccaggttagcgtgaattctgaattaggcagatcccacggcagcaccagttgcggcagcagttgcggaataccgttaccctgagaaccatcggccaggacgtagtggaattgcgaaccgatggtagcaacatgtccgccgagcaggttaacaatccccatcaccgcgcaaccagccagcaaggccggaaggtgaccgggtaaacgaatgcccagacgcggccaaaaaacaagaatacctagcgtcacaatgccaatggcagcatcacccacattaatggtcggcagcgccataaataatgcgccgactttttgtagataatgttccgggacatgggccatttgcagaccgagaaaatctttaatctgcatggtaccgatggtgatcccgatacccgaggtgaaacctaaggtgacggaaaccggaatatactcaatcaggcgaccaaagcgtgccagacccatcagaatcaaaaagatccccgacagcaaggtcgcaaccagcagtcctgccagtccaaactgttgcgacacgggatagagaattaccacaaatgccgcagtcggaccggaaacgctaaagcgtgacccacccgtcagagcaatgacaatccccgcaacagctgcggtatataaaccgtactggggtgccacaccactaccaatagccaacgccatcgccagcgggatagcaataatcccgacggttatcccggcaatcaggtcacgggtaaaccgtgcggcagtatatttttctttccagcaagcgtcgatcagagcgcggaaaggcatcacatgtgaggaaaatattttgttcacaataatgtttcatccgtgagcgcatcatctgtcaactaaatggcaggtgaaggaggcataggtcatacaaatggatattacagacaaaaaaacccgccgcagcgggtctttgagccgggttcgattagtgttcgaacatggcagagatcgattcttcgttgctgatacgacgaatcgcttcggccagcatacctgacagggtcagagtacgcacgttcggcagtgatttgatttcatcgctcagcggaatggtatcgcagacaacgacttcatcaattacagagttacgcaggttgttcgccgcgttgccagagaagatcgggtgagtcgcgtacgcaaatacacgtttagcaccacgttctttcagagcttcagcagctttacacagcgtaccgccagtgtcgatcatatcatcgaccagtacgcagtcacgacctgcaacgtcaccgatgatatgcatcacctgtgaaacgttcgcacgcggacgacgtttgtcgatgattgccatatcggtatcgttcagcagcttagcgatagcgcgggcacgcacaacgccgccgatgtccggagaaaccacaattgggttatccagattcagctgcagcatgtcttccagcaggatcgggctaccaaatacgttatcaaccggaacgtcgaagaaaccctgaatctgttcagcgtgcagatccactgtcagcacacggtcaacaccgacgctggagaggaagtctgcaaccactttcgcagtgattggtacacgagcggaacggacgcgacggtcctggcgcgcatagccaaagtaggggataacagcggtgatacgacctgcggaagcacgacgcagggcatcaaccataacgactaattccatcaggttgtcgttagtaggggcacaagtggactggatgatgaaaatatcaccaccgcgtacattttcattaatttgtacgctgacttcgccatcgctaaagcgacctacagcggcgtcgccgagtgaagtgtacaggcggttggcaatacgttgtgctagttccggggtggcgttaccagcaaaaagcttcatatcaggcacgagaagaacctcaggcatgcgtccattggtggaaagaatctgccgaaaactgtgcgggccaggcatgatcctttccaggcggtgtattaaagagcgcgatgcaacgtctggaacaaggtgacgttgtcaccgaaactcagcttgcccggcttaaagcatggctctgtgcaatggggaaagattagcgcctttcgccacaaagccattgagccattccggggcttgctctagcacctggcgggcttcagactctgtatcaaattcagcaaagacacaggcccctgtcccagtcaggcgcgacggggcgtattctaacagccaggaaagcaccgcatcaacctcgcgaaaacgttttcttgcgataacctcgcaatcattgctgaattcacattttagcaacgtttctattgacctttttggcgtattgcgcgggagttcaggatctttaaaaatcaccggagtcggaatacttacaccagggtgcgccaccagataccacttctctggcggatccaccggcgttagtatttcaccaacgccttcggcaaacgcggcatgcccccgaacaaagacaggaacatctgcgcccagcgtcagccccatttccgccagctcatccatgcttagcccgcattgccagagatgatttaatgccaccaggaccgtcgcggcattggatgaaccaccgccgagaccgccgcccatcggcaaacgcttgtcaatgctgatattcgcaccgcttcccgtcggaagacgcccgctgtctgccgcagttttcatcaacaatcgcgctgcgcgaacgatcaggttatcttcatgttccacgccttcaacgggcgttaacagacgaatatccccatcgtcacgaagctcaatgctgatggtgtcgccgtaatcaagaaactgaaacagcgtttgcagcgtgtggtaaccatccgcacgctgaccggtaatgtataaaaacagattaagttttgccggagagggccactgtgtccgcattatttcactatccagttatccatttttaacttgatgcgttgaccaccgtcggtgagttccatattggctggcatcgcaggttgcgttttggtgtcataaccaccataaacaaccttccagtttttgccattctggctgtaggtaatttcgctcaggcggtactggtcgtccagtttgtagtcggttgcatcacccggtaaacctaaaatccactggcgcaagctgttgagcggaattggcattccggtcaatttgccaatcatctcttcggcgtcatcggcggtataacgctgacctttattgtcgactaactgcacgttacccggttgagcattcagctccagttccgtgctgcccaatgggttagtgagcagcagacggtagcgatcctggccggtttgctgccagaaaaagcgggcgtacactttttgttggtcagaaatataagcgaacgcgccgcgagtctgatactgattaagattgcgcacgtcttgctgatgctgacgccattgtggcgaatccgggcttttgccaggacctttgggcgtggtaacggaacaggcagtgagcacaagagcagccagcggtagcaggcggataagacgaaaatcgggcaggggcatagtgatgacaagtccttgagatacgttgcagttataacccttaatgctagcgttaccgtccgctatcgtctatgttcaagttgtcttaattgccagaatctaacggctttcggcaattactccaaaagggggcgctctcttttattgatcttacgcatcctgtatgatgcaagcagactaaccctatcaacgttggtattatttcccgcagacatgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggacaacctgcaagaggcgttaatccgctggctttgcgattatcacaatcttaatgaagaagatctgcgtaaaagcctctactggcatcaggataacgacgcggttagccatttaatgcgtgttgccagcggcctggattcactggttctgggggagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaactatcgagctggtggcgcgtcatctgcgcgaacacaaagtacagaagatgattatcgccaaccgcactcgcgaacgtgcccaaattctggcagatgaagtcggcgcggaagtgattgccctgagtgatatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgttgatgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtagcagtacatcattttctttttttacagggtgcatttacgcctatgaagccttctatcgttgccaaactggaagccctgcatgaacgccatgaagaagttcaggcgttgctgggtgacgcgcaaactatcgccgaccaggaacgttttcgcgcattatcacgcgaatatgcgcagttaagtgatgtttcgcgctgttttaccgactggcaacaggttcaggaagatatcgaaaccgcacagatgatgctcgatgatcctgaaatgcgtgagatggcgcaggatgaactgcgcgaagctaaagaaaaaagcgagcaactggaacagcaattacaggttctgttactgccaaaagatcctgatgacgaacgtaacgccttcctcgaagtccgagccggaaccggcggcgacgaagcggcgctgttcgcgggcgatctgttccgtatgtacagccgttatgccgaagcccgccgctggcgggtagaaatcatgagcgccagcgagggtgaacatggtggttataaagagatcatcgccaaaattagcggtgatggtgtgtatggtcgtctgaaatttgaatccggcggtcatcgcgtgcaacgtgttcctgctacggaatcgcagggtcgtattcatacttctgcttgtaccgttgcggtaatgccagaactgcctgacgcagaactgccggacatcaacccagcagatttacgcattgatactttccgctcgtcaggggcgggtggtcagcacgttaacaccaccgattcggcaattcgtattactcacttgccgaccgggattgttgttgaatgtcaggacgaacgttcacaacataaaaacaaagctaaagcactttctgttctcggtgctcgcatccacgctgctgaaatggcaaaacgccaacaggccgaagcgtctacccgtcgtaacctgctggggagtggcgatcgcagcgaccgtaaccgtacttacaacttcccgcaggggcgcgttaccgatcaccgcatcaacctgacgctctaccgcctggatgaagtgatggaaggtaagctggatatgctgattgaaccgattatccaggaacatcaggccgaccaactggcggcgttgtccgagcaggaataatggaatatcaacactggttacgtgaagcaataagccaacttcaggcgagcgaaagcccgcggcgtgatgctgaaatcctgctggagcatgttaccggcagagggcgtacttttattctcgcctttggtgaaacgcagctgactgacgaacaatgtcagcaacttgatgcgctactgacacgtcgtcgcgatggtgaacccattgctcatttaaccggggtgcgagaattctggtcgttgccgttatttgtttcgccagcgaccttaattccgcgcccggatacggagtgtctggtggagcaggcactggcgcggttgcctgaacaaccttgccgtattctcgatctcgggacgggtaccggggcgattgcgcttgcgctggctagcgagcgcccggactgcgaaattatcgctgtagatcgtatgcctgatgctgtctccctggcacaacgtaatgcccagcatctggcgatcaaaaatatccacattctgcaaagcgactggtttagcgcgctagccgggcagcagtttgcgatgattgtcagcaatccgccgtatattgacgagcaggaccctcatcttcaacaaggcgatgtccgctttgagccgctcactgcgctggttgcggcagacagtggaatggcagacatcgtgcatatcatcgaacagtcgcgtaacgcgctggtatccggcggctttctgcttctggaacatggctggcagcagggcgaagcggtgcgacaagcatttatcctcgcggggtatcatgacgtcgaaacctgccgtgactatggtgataacgagcgcgtaacgctcggccgctattatcaatgacaagtttttctacactgcttagtgttcatcttattagtatcgcgctttctgttgggctattaaccttacgtttctggctacgttatcagaagcatccacaggcatttgctcgctggacgcgcattgtgccgccggttgtcgatacgctgttactgttaagcggcattgcgttgatggctaaagcgcacatcctgccattttccgggcaggcacagtggctgactgaaaagctgtttggagttatcatttatatcgttttgggttttattgcactcgattatcgtcgtatgcacagtcagcaggcgcgcattattgccttcccgctggcgttggtggtgctgtacatcatcattaaactcgccaccacaaaagtaccgttactggggtaagtcatgagatcgttagctgatttcgaatttaataaagcgccattgtgcgaaggcatgatcctggcttgcgaagcaatccgccgcgattttccctcgcaagatgtttacgacgaactggagcgtctcgttagtctggcgaaggaagaaatcagccagcttctgcctttagaagagcagttggaaaaactgatcgcgctgttttacggcgactggggatttaaagcctcacgcggtgtttatcgtctttccgatgcattatggctggaccaggtgttaaagaatcgacagggcagtgcggtatcattaggtgcggttttattatgggtcgcgaatcgtctcgatttgccgctgctgccggtgattttccctacgcagctgatattgcgcattgaatgtccggatggcgaaatttggctgattaatccttttaacggtgaatcgttaagcgaacatatgctggacgtatggttaaagggaaatatcagcccgtcggcggaactgttttatgaagaccttgatgaagctgataacattgaggtaatccgcaaattgctggatacactcaaagcctcgttgatggaagaaaatcagatggagctggcgttacgcaccagcgaagctttattacaattcaaccctgaagatccctatgaaattcgcgatcgcgggttgatttatgcgcaactggattgcgaacacgttgcgttgaacgatttaagttatttcgttgaacagtgtccggaagacccgatcagcgaaatgatccgtgcgcaaataaataacatcgcgcataaacatattgtgctgcattaattaatcgacattttactcaagattaaggcgatcctatgaaacaaaaagtggttagcattggcgacatcaacgtagcaaatgacctgccgttcgtactgtttggcggtatgaacgtgttggaatctcgcgatctggcgatgcgcatttgcgagcactacgtaactgtgacccagaaactgggtatcccttacgtgttcaaagcctcttttgacaaagccaaccgctcctccatccactcttatcgtggaccgggcctggaagaagggatgaaaatcttccaggagttgaagcagacttttggcgtgaaaattatcaccgacgttcacgaaccaagtcaggcacagcccgttgctgatgtcgtggatgtgattcagttgccggcgtttcttgctcgccagactgacctggttgaagccatggcgaaaaccggtgcggtaattaacgtcaagaaaccacagtttgtcagcccgggacagatgggtaatatcgttgataaattcaaagaaggcggcaacgaaaaagtgattctttgcgatcgcggtgctaacttcggctatgacaacctggttgtcgatatgctgggcttcagcattatgaagaaagtgtctggtaactcgccggtgattttcgacgtgacccacgcactgcaatgccgcgatccgtttggcgcagcttccggtggtcgtcgtgctcaggtggctgagctggcacgagccggtatggcggtaggtctggcggggctgtttattgaagcgcatccggatccggaacatgcgaaatgtgatggtccatccgcgctgccgctggctaaactggaaccgttcctcaagcagatgaaagcgattgatgatctggtgaaaggtttcgaagaactggataccagcaagtaatcttttttgcttgaaaaataaagtattagcgttctgcgttaagacttttttcatgggtgccggatacaaaaaaggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaattgttctggttcaagattagcccccgttctgttgtcaggttgtacctctcaacgtgcgggggttttctctttccagcaaccaatgccaccagggataaagcccccgcaacattgcgcctcaccggataacgccggcttggtgtggatactacgactcaattcatcttcacttcatccctgaaatgtttgcaatgaagagtgcattccggtttttcaacagctgttacagtcatttcatgagtgctctggatgaggcttccagctcgggttgccaatatttacttgtggaagtgataaagacaaaaatggccgcaggctgttacccctgcggccggtttcgggcgcatattgccatcacggcagcctgacgcccgttttcaccttacttccggttacgccaccagccgacaatcgctgcggtaataattcccgccaggatcggtgccgccaggtcgtgccagaaagtcatggcaaactgcgcgagcgtcatatagccgccttgttgtaatgacaacattttgcggctattcttgaagtgtctggtttcaagattagcccccgttctgttgtcaggttttacctctcaacgtgcgggggttttctctttccagcaaccaatgccaccagggataaagcccccgcaacattgcgcctcaccggataattccggcttggtgtggatactacgtctcaattcatcttcacttcatccctgaaatgtttgcaataaagagtacattccggcttttcaacagctgttgcagtcgtttcatgagtgctctggatgatgcttccagctcgggttgccaatatttacttgtggaagagataaagacaaaaatggccgcaggctgttacccctgcggccggtttcgggcgcatattgccatcacggcagcctgacgcccgttttcaccttacttccggttacgccaccagctgacaatcgctgcggtaataattcccgccaggatcggtgctgccaggtcgtgccagaaaatcatggcaaactgcgcgagcgtcatatagccgccttgttgtaatgacaacattttgcggctattcttgaagtgtctggtttcaagattagcccccgttttgttgtcaggttttacctctcaacgtgcgggggttttctctttccagcaaccaatgccaccagggataaagccccgcaacattgcgcctcaccggataacgccggcttggtgtggatactacgtcgcaattcatcttcacttcatccctgaaatgtttgcaatgaagagtacattccggcttttcaacagctgttgcagtggtttcgtgcagggtgtggtacaggctcgcaattctgattaacgacctgtccaggtagtatgaagaaatacaataagcaggaatttatattatctcccccgattaccgtcatcggaggagatataactgtcaggcaaatatcgtcatcaaataggcggcaaacagtgccagatgcgctgcgccattgagcacgttagtacgtccggtggagaaggagatatggcacagcactaaagaggccaccatcaccaccatttctggcgcaccaagtgcaaactgcaattcgttacccgtcataaaggcaattagcgtgacgacaggtacggtaagcgaaatggttgctaacactgaaccaaagaacagattcatcgcgcgctgaacctggttgttcaacactgcttttaatgcacctaaaccttccggcgacagaatcaacagtgccaccaggaagccagtaaaggcgacaggggcattcatgctgtcgagcaatgtctccagcgagctggcgttcattttggtcaccgcaataacggcaatcagatggataatcaaccagatagcatgccacaggctgctatgggcagacggtttaccgtgatgcgggtcgtcatcatcactgtcatcttcgtgctcgtagacaaacaaactttgatgcgttttggtctggatcagcaaaaatacgccatacattgccgcagaaattaatgctaccagtaacgcctgaccggttgaaaaattcgccgcaggcagagccattggaaataccagtacgattatcgccagggggaacagcgcaattaaatactgcttgataccaaacagattcatatattgggtggcaaacttacgaccgcccaacaataatgaaaagccaaccagcccaccggtaacaatcataatgattgaatagagcgtatcacgcattagcgttggcgcggcgtcgccggttgccattaaagctgaaatcaaactgacttcaagaataaccactgaaaggctaagaataagcgaaccgtaaggttctcccaggcgatgggctaatacgtccgcatgacggacaacactaaaggcgctacttaaaataccaataagcgcaagaagattgatggcaatgaccactggtagtgtctggctgcttccccacaggaacagcactaccagcgccagaaccgggaaaataagcgaagtctccttgtggcgggtttttaccgcctcttgagcatttgacattatggttatccctttgcagatgaatttatcgaaaatgtaaaaaataggtaggaaaaataacagaaagtgtctggatatcggtaacattttacgaatttttaccccgctgtcgattttttactcattggggcataaaaataagtattacgtttagacaatgtttgttttagcgtctcttaagaagagtctgacctgaaaattcttatgttttggcaagagtagatattgttgaccacacttaatgttcaactttgtaaaaggagtcaacgatgccgtataaaacgaaaagcgatctgccggaaagcgtaaagcacgttctaccgtctcatgcccaggatatctataaagaagcgttcaacagcgcatgggatcaatataaagataaagaagatcggcgtgatgacgccagtcgcgaagaaaccgcgcataaagtggcctgggctgctgtgaagcatgaatatgccaaaggggatgatgataaatggcataaaaaatcgtaaaaccggtcgcttagttaaagctattcgtgcggtgttgccttgcaagtggtccgtggattgcatattgtcccgttagtggtttcaaaatgagcagtaaaaatgtccggaagacaccaaaaagttgtcgcagggaagtatgcagtggcggaagtgtaaggtgataacgcgtgatttcttgatgaatgccgattgtaaaacggcatttggtgccattgaagaatcactcttatggtcagcagaacaacgggcggcttcgctggcggcgacgctggcttgtcgacctgatgagggaccggtgtggatcttcggctatggatcgttgatgtggaatccggcactggagtttaccgaatcgtgcaccggtacactggttggatggcatcgcgcattttgcctgcgcctgaccgccgggcgcgggactgcgcaccagccgggacggatgcttgcactgaaagagggcggacgcaccacaggcgtcgcctatcgactgccagaagagacgctggagcaggaactaaccctgttgtggaagcgagagatgattaccggctgttatctgccaacctggtgtcagcttgatcttgatgatggacgcacagtaaacgccattgtgtttattatggacccgcgacatccagaatatgaatctgatactcgcgctcaggtcatcgcgccgttgattgcggcggcgagcggtccgctgggaaccaacgcacaatacctgttttcactggaacaggagcttatcaaactgggaatgcaggacgatgggctgaatgatttgctggtatcggtaaaaaaactgctggcggagaattttccggatggtgtgttacgtccgggattcgcctgagtaaacttcccgcatagtggggcgtcagacgccccctcaaacattaaaatgtgagcactttatcggctgacagcgtccattgcgccagttccacaagagtaccgatttccaccccatcaatcagaggaagtgtactaatcccgcgcccgtcggtacaggttttgcacaatttcaccggtacattctgagcggtaaggatctccagcatttgctgaatgttgtagccttcccctggtttttgcccgcgcaacccggctgtgaccgcatcagacatgaggaacagacgcagatccagattgctctcctgctctcgtaacgcaatggccagccgcaagctgttaaacaaggattcgctcccgtaaggtgcgccattggcaacgatcacgattttttgcattatttactcctgtattcagggaattagacactcatcttctatcttactgcttctgcagcgtctgaccaatcggtcacatttttaaggattttcctgaaagcgcgagaaaatacgacaaaagttgccagtaatcgttattctttaaggctatggtttttcattattaccggaagttaccgacgttttgagccgtttcgttcctcgcattatcccgttttatttactcttgcttgtagcaggcggtacagctaacgcacaatctaccttcgagcaaaaagcggcaaatccctttgataataacaatgatggtctgccggatttaggcatggctcccgaaaatcatgatggggaaaaacactttgctgaaattgtgaaagatttcggcgaaaccagtatgaatgataacgggctggatactggcgagcaggcaaaagctttcgcattgggaaaagtccgcgacgcgcttagtcaacaggttaatcagcacgtagagtcctggctatcaccgtggggaaatgccagtgttgacgtcaaagtggataacgaaggacatttcaccggcagtcgtggaagctggtttgtgccgttacaagataatgatcgttatctcacctggagccagcttggtcttactcagcaggataatgggttggtgagcaatgtgggcgttgggcaacgctgggcgcgcggcaactggctggtgggttataacactttttatgacaacttgctggacgaaaatcttcagcgagcgggctttggtgccgaagcgtggggcgaatatttgcgattatcggcaaacttttatcagccgtttgctgcatggcatgaacagacagccacgcaggaacaacggatggcgcgcgggtacgacctgacagctcggatgcgcatgccgttctatcaacacctcaataccagtgtcagcctagaacagtattttggtgatcgtgttgatttgtttaactctggtacgggttatcacaatcccgtcgcgttgagtctgggattaaattacacccctgtgccattagtcactgtgacggcccagcataaacagggtgaaagtggcgaaaatcaaaataacctcgggctgaatcttaattaccgctttggtgtaccgctcaaaaaacaactttctgcgggcgaggttgccgaaagtcagtcgttacgtggtagtcgctatgacaatccgcagcgaaataatctaccgactcttgagtaccgacagcgaaaaacgttaacggtgtttctggcgacaccgccgtgggatctaaaacctggcgaaacagtgccgctgaaattacaaatccgcagtcgttacggtattcggcaactgatttggcagggcgatacgcagatattaagtttgacgccgggcgcacaagccaacagcgcggagggctggacgctgatcatgcctgactggcagaacggggaaggggcaagcaatcactggcgattgtctgtggtggtggaagataaccaggggcagcgtgtctcctccaatgagatcacgctaacgcttgtcgaaccgttcgatgcattgtcaaacgacgaactgcgctgggaaccgtaatcagaaaatgcgctcctgatgcacccataccgctgcttccacgcgagacttgagcttcattttcttcagcatgtgcttgacgtgcacttttactgtgctttcggtgatatccaggcggcgggcaatcatcttgttcggcaaaccctgggcaatcagcttgagaatatcgcgctcgcgtggggttaactggttaacatcgcgctcagtagtggcacggttagcgcgcaagctggcggccagaacaggcgttaatgcttcgcttaataccatttcgccagcagctgcctgatgcaatgctttcagcagatcttccggttccatatcttttaacagatagccatccgcgccgcgtttcagtgcggtgaccacatcttcttcatggttagagacgctgaataccacaatgcgccctgagagggacttttcgcgcagtttatccagcgtttccagaccgttcatgccgggcatattgagatctaacaggatcagatcgggatcaagagactccgccagttcaataccctgttcgccattactcgcttcgccaaccacggtgatatctggtgccatactgataagctgttttacgccagttcgcagcatcgggtgatcgtcaatcagcaggatagtagccggttcctgattactcatgggtatctccttggacgtctgtgaaagttttttcgggaataaaggtgaccaccacttcggtgccacctgattcacgacggcggacgcggcaatcgcctcgtaaactttgcgcacgatcgcgcattattatcatgccgtagtgattgctgcggatggcattttcaggcacgccgcagccgttatcctggacggtcagtttgacctgattatcgttttgcgccaccgtcaccacgacttcactcgcttgcgaatgtttgagggcgttacttaatgcctcacgggcaatttgcaacaagtggattgcctgatgcgaaggcaccaggcgaggcggcaattgataatccagcttcaccgggaagccaaatttggcgctgtactcttcgcaactcgcctccagcgccggacgtaatccaggctcggtgagctgcaagcggaatgtggtgagcaattcacgcaactgcgcccaggatgcattcagttcgttacggatctgacttaacagttcgcggctgctttctggcagcgcatcgccctgcatctgtaaacaactcacctgcatcttcatgcaagagagagattgggcaatagaatcatgcagttcgcgcgcaatggtggcacgctcttccatcacgatcaactgttgctgacgttcctgatggcgatccagcgccagcgtggcggtgagttgttcaaccagggtatccaccagttgttgttgatcatggctaagatgacgcccctgcggcagggtcgccagcaaaataccgtactgcgtatgagagtcagccagccgccacttcagggtcgtgccgcgatcaccaacgggtaatacgccgcgcgggcagagctggcagcctttatcatcacaagtcatatctggctggcaggtaaactcctgatgattctcttcatcatcagtgtcatacacccgcaattcgatatcacgtagcagggttaaattctgtaagccgttgagtacaggtgacaggcgttcacacagcggggcgcgggaatgcaaacggcggttagcctgccataaaaaagagaggatctgatttttatgctccagcccggcggttttctcctgaacccgctgctcaagtacggcataactttcggccagttctgcagacatattgttcaacgcagttccaagcatcgccatttcgttgcgcccgctgatgtttgcgcgttgggtaaaatcgcgatgactgacggcactcgccattgccagcagttgccgccacggttgtagcagtcgcgcccgcaaccagataatagtgaacaccagtaaaagtgccataaataccgccattacccgatggaccagtaccactgtctcgatgcgcatttccgtggtgcggtcaaaaccagataccagttgatcaagcccggcaacaaactggctgacatccgctgacaccgtttctcggttttgtgcacgcatcagcgcagggatcagttcattacgccagtaatcttgtaaaccctgtaattgcgccagttgtccgtctcgttctgctgctcgagtcaactcggcgctaaatgccgtttgttccatctctttaattaagggcttgtctttctcgcttaatggcactgccgccaacagacggtaactttgcatgcgcagcgatcccgctttgttgatcgcatgggcgctgccctgaacgccttgcaccagccagccagaaaccgccatccctgccagtccaatagcagtagaaagcaacacaataagcgcaacctgattaaccagggtgagcggagagagacaacgtttaagcatgtaaacctcttccttcaggctttaaatgagcaataaccttaatgaatgtgacgatacattctggaatggcagtattctcggctattggctgaagtatacccatacccggaaagagttactccttatttgccgtgtggttagtcgctttacatcggtaagggtagggattttacagcaccgtgaaaaatctcataatttttatgaagtcactgtactcactatgggtaatgataaatatcaatgatagataaagttatcttatcgtttgatttacatcaaattgcctttagctacagacactaaggtggcagacatcgaaacgagtatcagaggtgtctatgagtcactcatccgcccccgaaagggctactggagctgtcattacagattggcgaccggaagatcctgcgttctggcaacaacgcggtcaacgtattgccagccgcaacctgtggatttccgttccctgtctgctgctggcgttttgcgtatggatgttgttcagcgctgttgcggtgaacctaccgaaagtcggctttaattttacgaccgatcagctatttatgttgactgcgctgccttcggtttctggcgcgttattacgtgttccatactcctttatggttcctatcttcggtggtcgtcgctggacggcgttcagcaccggtattctgattattccttgcgtctggctgggttttgccgtgcaggatacctccacgccttatagcgtcttcatcatcatctctctgctatgcggctttgctggcgcgaacttcgcatccagtatggcaaacatcagcttcttctttccgaaacagaagcagggtggcgcgctgggtctgaatggtggtctgggaaacatgggcgtcagcgtcatgcagttggttgctccgctggtggtatcactgtcgattttcgcagtatttggtagccagggcgtcaaacagccggatgggactgagctgtatctggcgaatgcgtcctggatatgggtgccgttccttgccatcttcaccattgcggcgtggtttggcatgaacgatcttgctacctcgaaagcctccatcaaggagcagttgccggtactcaaacggggtcatctgtggattatgagcctgctgtatctggcaaccttcggctccttcatcggcttctccgcgggctttgcaatgctgtcaaaaacgcagttcccggatgttcagattctgcaatacgctttcttcgggccgtttattggtgcgctggcgcgttctgcaggtggtgcattatctgaccgtctgggcggaactcgtgtcacgctggtgaactttattctgatggcgattttcagcggcctgctgttcctgaccttaccgactgacgggcagggcggaagcttcatggcgttcttcgcggtcttcctggcgctgttcctgacagctgggctgggtagtggttccactttccagatgatttcagtgatcttccgtaaactgacaatggatcgcgtgaaagcagaagggggttctgacgaacgtgcgatgcgtgaagcggcaaccgacacggcggcggcgctgggtttcatctctgcgattggcgcgattggtggcttctttatcccgaaagcgtttggtagctcgctggcattaacgggttcgccagtcggcgcaatgaaggtatttttgattttctatatcgcctgcgtagtgattacctgggcggtatatggtcggcattctaaaaaataaaccgttactcgtcatacttcgggttacatgtgctgcggctgcgttcattcaccccagtcacttactttagtaagctcctgggattcattcacttgccgccttcctgtaaaccgaattatatagagtaaaatatttgattatcctttgcgcggcatgatgtcgcgctttttttatgcgtcatttagttacaacatactaatgttatatggtttatttcgccggatttcattaagagccattaatatgttacccatggggaatactccttaatacccatctgcataaaaatcttaatagtttaaataactacaggtataaaacgtcttaatttacagtctgttatgtggtggctgttaattatcctaaaggggtatcttaggaatttactttatttttcatccccatcactcttgatcgttatcaattcccacgctgtttcagagcgttaccttgcccttaaacattagcaatgtcgatttatcagagggccgacaggctcccacaggagaaaaccgatgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacttgcctcctgcgtctccgcaaacctggggcgagcaaactgacgtaccggaatctgctgactggtacaactccagctacatcatcgcctgggggtcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgctgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgagtgcgacctgatcccaggtaaaaccgcgccacacattatggtcgtagagcgcgattatccggcgacttacgaacgctttacctctatcggcccgctgatggagaaaatcggtaatggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaaccaggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtcttcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactatggcaccgtaggttctaaccgcgatgagtttgttgtagtgcgtaagatgaagaacattgactggttagatggcgaaggcaatgaccaggtacaggagagcgtaaaatgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctgtttgaacatgtgcacggcgaatcccgcgaccgcggccaggcgatggtggacctgctggcgcagtacgagcagcacggcttgcagttaaacagccgcgaattgccggaccatctgccgctgtatctggagtacctggcgcagctgccgcaaagcgaagccgtggaaggtttgaaagatatcgcgccgattctggcattgctgagcgcgcgtctgcaacagcgtgaaagccgttatgccgtgctgtttgatctgctgctgaaactggcgaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgcgcatcagcgtcgctttgccggtgccgtcgcgccgcaatatctgaatatcaccaccggaggacagcactaatgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcgggattctggggatttttgtcggtcacttcttcggtatgctgacgccgcactggatgtatgaagcctggctgccgattgaagtgaaacagaaaatggcaatgtttgctggtggtgccagcggcgtgctgtgtctgattggcggcgtgctgttgctgaaacgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgctggggatgacgttattcctgctgttcccgttctcgcgtctgatacacatctggagcgtaccggtggagtatctgacacgtaagtaccagctggtgcgcgctcgtcactaagcgaattttagttcacatagaccctgcttcggcggggtttttttatgggcacggtgcggggtgagttgtcggatgcgcttcgcttatccgacctacaggggaggatattgtaggcccggtaaacgtggtgccatcgggcaaaattagctcggagtaacaggttttgattatttaaggaagcgatggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttagtcgaagcttctcatccttccccgcatgggcagaatatttgattgcggattcgcttgagagttcagggacttttgaaagtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaatgctttttactggcctgctcccttatcgggaagcggggcgcatcatatcaaatgacgcgccgctgtaaagtgttacgttgagaaaaatgaactggttgcgtaattttcatccgtaacggattaaaggtaaccagttatttttgctggcgattaaagaataatcgttcgattaccgtaaacaaagacgcgctgtgccagtactttgtatagtgcacgacttaagacgtttttctcgacgtcacgacctgcgcgcatcatatcttcagctgtgtaggtatgatcgacatgaataacgtcctgcatgatgattgggccttcgtccagattgtcattcacatagtgagcggttgcgccaataatcttcacaccacgttcataggcctggtgataaggacgtgcgccaataaacgctggcaggaatgaatggtgaatattgatgatcttattcgggaagcgtgccacaaattccggcgttaatacccgcatatacttcgccagcaccacgtagtcaggttgataagcatcaatggcatccgccatcttttgatcgtgctcgttgcgggttaacccttcatggcttaccagctcaaacggaatatcaaaacgctcaaccagagaacgtaaagtatcgtggttaccaataactgccgcgatttcgacatccaggccgccgtaattggctttcatcaacaaatcgccaaggcaatgcgcttctttagtgaccagaatcactatccggcgacgaccggcaggattcagctcacgcacggagccttctggcaatgcgctatcgagatccgccagcagggtggaatcattaaaaatcccttccagttccgtgcgcataaaaaagcgcccggtacggtgatcaacaaattcattgttctgtacgatatttaactcgtgcttgtagcaaatattggtaatacgtgcgatcagacctttttggtccggacaaatagtacgcagaactttacgttggagtgaatgcattgctggaaaaaccttgttgagagtgtttgctaaaccgtaccgtcaaccattattggccgcagcactttttaaattttttacctgaaccacaagggcagggatcgttgcgaccaaactgcggacgtgtaccgtcaatatagtaccattgaccgttttctttcaaaaatcgcgaacgttcaattattgcacctgttttaccaccttcggtaaatcgagcaacaaaactgacaaatccgatattgtcggcgtcctgccaacaatgttcaaatacggtcaatcccaaccattcagtatgcgcaaatccggccatcaattcggcacgtaacgccgctgctccacaagagggatgccaggtctttattaaataatctgcgtcttgcatcacaaaagcgcagtaacgcgaacgcatgagatgttctggatcaggtgcaaccttttcaccagacacataagggtggcaacataggctatactcgacagcactaccacagggacaaagctgagacacaaataatctccctggaaacaataacggcgtattaaccgcctgagtagcactatgttaaccgagcagtagcgatgtggctacgattgcattccaggggaatcttgcgggaataatgagaaagataaaaatagggctggcgctgggatctggcgcggcgagaggttggtcgcatattggcgttattaatgcgctaaaaaaagtgggtattgaaattgatatcgttgcaggatgttcaattggttcgctggtgggcgctgcctatgcatgcgatcgattatctgcgctggaagattgggtgacctctttcagttattgggatgttttacgcctgatggatctctcctggcagcgcggtgggttactgcgcggcgagcgtgtcttcaatcaataccgcgaaataatgccggaaacagagatcgaaaattgttcccgtcgctttgcggctgttgccaccaatttaagtacgggacgtgaattatggtttactgaaggcgatctccatcttgctattcgcgcatcatgcagtattccaggactcatggcacctgttgcacataacggctactggctggttgatggagcagtcgttaacccaattcctatttccctcacgcgtgcattgggggctgatattgtgatagcggttgacctgcagcacgatgctcatttgatgcaacaagatttgctctcctttaatgtcagtgaagaaaatagcgagaatggtgattctctgccgtggcatgcgcgtctgaaagaaaggttaggcagcataacgacacgtcgggcggtgacagcgccaacggcaacagagattatgaccacttctatccaggtgctggagaaccgccttaaaaggaaccgcatggcaggtgatccgcccgatattctgattcaacctgtttgcccgcaaatatctacgcttgatttccatcgcgcgcacgctgccattgcggccggacagctggcagtggaaaggaaaatggacgaacttttgccgttggtacgcaccaacatttgaccagaatttttatctacacttaagttaattctgacaggcgcaggtggcaatagcatgccactattgagtaaagccagtcaggggagagaacatgacgcagccattggtcggaaaacagattctcattgttgaagatgagcaggtatttcgctcgcttctggattcatggttttcctcattgggagcgacaacggtactggcggctgatggggtggatgcccttgagttgctgggaggtttcactccagacctgatgatatgtgatatcgcgatgccacgaatgaacgggcttaaactgctggagcatatacgtaacagaggcgaccagaccccagttctggtgatatctgccactgaaaatatggcagatattgccaaagcgttacgtctgggcgttgaagatgttttgctgaaaccagttaaagatctgaatcgcttgcgcgagatggtttttgcctgtctctatcccagcatgtttaattcgcgcgttgaggaagaggaaaggctttttcgcgactgggatgcaatggttgataaccctgccgcagcggcgaaattattacaggaactacaaccgccggttcagcaggtgatttcccattgccgggttaattatcgtcaattggttgccgcggacaaacccggcctggtgcttgatattgccgcactttcggaaaacgatctggcattttattgccttgatgtcacccgagctggacataatggcgtacttgctgccttgttattacgcgcattgtttaacggattattacaggaacagcttgcacaccaaaatcaacggttgccagagttgggcgcgttattgaagcaggtaaaccatttacttcgtcaggccaatctgccggggcagtttccgctattagttggctattatcatcgcgaactgaaaaatctcattctggtttctgcgggtctgaatgcgacgttaaataccggcgaacaccaggtgcaaatcagtaatggtgttccgttaggcactttaggtaacgcttatttgaatcaattgagccagcgatgcgatgcctggcaatgccaaatatggggaaccggtggtcgactgcgcttgatgttgtctgcagaatgagcaaacgataacgcgggctaaatttgcattacctgctaatgtcggctggtggtactatcgtcgccattcgtataagtaattgtcttaattatgctaactcgcctccttttcagaacttagccccttcggggtgctgatatactgggatgcgatacagaaatatgaacacgttcaaaacacgaacagtccaggagaatttaaatggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaacatccgtatcggtgttatccacgaaacggcgttgagcaatcgacgccgtttttttatagcttattcttattaaattgtcttaaaccggacaataaaaaatcccgccgctggcgggattttaagcaagtgcaatctacaaaagattattgcttgatcaggaaatcgtcgagggatttaccttgctcatccattgcttttttgattacagctggagtacggccttggccagtccaggttttagtttcgccgttttcgtcaacgtagctatattttgccggacgctgagcacgtttagctttggtgccagatttaacggcagcaaggctattcagcagttcgttcgggtcaataccgtcagcgatcagcatttcgcgatattgctgcagtttacgagtgcgctcttcaacttcagcagcagccgcgctttcttcttcgcgacgttcgttaacaacaacttctaatttttccagcatttcttccagcgtttcaagtgtacattctcttgcctgcgcacgaagagtacggatgttgttcagaattttaagtgcttcgctcattgtagtaatctcaaacttatattggggtggtttgttgaggtaataatagagccttaaattcagttgtgcaatagccaggaatgtaaggaattcaaaattgttctttattttgtgccgccaataaatatcttttcataaaattagccagaaaagacgcggcatatagccctatttacaccgatgatttcgcagcacgtgaggttaaaacttcctgattcatgtcacattttatggggagattatcgtaggctgacgacctttcagtcttctgtattagttgtgtttacgagaattccctattaagcgaatgatgaaaagtagaacagtcgcaataagagcatggacttagtattgcactatctcctggaggtcaacagagggctattacttgcgcaacaggttaaagattgtgaatagttaccagcagtcatttacccgcttataacaagcgaggcagttgtaatgatagctcagaaggattatgcaaggcttcgtaagggagaacgcatatacccacttctgtgcatactgttgagctgaaaaactgacgaattatgataaactccagccaactttatttcatatcattgagggcctgtggctgatggcacagctatatttctactattccgcaatgaatgcgggtaagtctacagcattgttgcaatcttcatacaattaccaggaacgcggcatgcgcactgtcgtatatacggcagaaattgatgatcgctttggtgccgggaaagtcagttcgcgtataggtttgtcatcgcctgcaaaattatttaaccaaaattcatcattatttgatgagattcgtgcggaacatgaacagcaggcaattcattgcgtactggttgatgaatgccagtttttaaccagacaacaagtatatgaattatcggaggttgtcgatcaactcgatatacccgtactttgttatggtttacgtaccgattttcgaggtgaattatttattggcagccaatacttactggcatggtccgacaaactggttgaattaaaaaccatctgtttttgtggccgtaaagcaagcatggtgctgcgtcttgatcaagcaggcagaccttataacgaaggtgagcaggtggtaattggtggtaatgaacgatacgtttctgtatgccgtaaacactataaagaggcgttacaagtcgactcattaacggctattcaggaaaggcatcgccacgattaataagaatttctttactgacagggtgagcagggcacttttatcctgtcagttcgttttacgcacttcttccgggctatatacccttctcggcagttttttaacgccgctatacgcctcacagggctcttaagcaccgacgttgacttgtgacctgtaaagtacaatatccctgtgtttaggcgttatacatcgtcgcaaatatgatgaaggctaatgctgtcggtttatggaaaagttgctttgggtaaacaaaaaatacggccccagaagggcaatgccgttcacttaagaggagcggcactatgtttcacaggataacgggtttttgatatcttaaccgacctcggccttgatggtcgggggcgttttgttatgaacaccacttccagagcaccccgaagatgctccagtcgtttcgggatggtccctggtgacgccgtgtttcccagctctatcatttctgatgcgatattcttccacgcaggcagtagccagtggcggttacaacccttctggttcagcgtcagcagcaggtcttcgctgtaaaaaagtttatcaaacaacgtaatagagttatccgggatggtggcgagcatggagtgggccagcacagtttcgctctgccggtaaggtgcggtcacggcattcagcagaatgtgacttcccaggttcattaaggccaccagacgcataaccgggtaggcgttctgccgcttagtggatgtgttggcagacccataatattcacgcagctcgggtttatcaggtgtcctgaactgtgcgccatcaatggcaaaaagttgcaggccgtgccagtcatccttcaggtaacgttccgcgcccctgtctgtgcggtctggcggaagagccattccactggggcggcccccacgcgctgacgcgcctgggtgacagcgctgcgggccagcaggttcatccccgcttcgccatccgcgctcaggttcagacggcgaacaacatcggtaattggctcattgcaccaccatccagataaccatgtcccccggtaaacgacggcggcgaacggtcgcatgagcagaaagcgtcaggcagtgttgtatccactcggtgggaaggtgttctgcaaatagttgtgcagagggcggaggcataagcggatggtcactgaaatcgagcagatcattgagaagtggcataagaaaacggctccctgttgtggaagccgttatagtgcctcagtttaaggatcggtcaactaatccttaactgatcggcattgcccagaaggggccgtttatgttgccagacagcgctactgattaagcggattttttcgcttttttctcagctttagccggagcagcttctttcttcgctgcagtttcaccttctacataatcacgaccgtagtaggtatccagcagaatctgtttcagctcggagatcagcgggtaacgcgggttagcgccggtgcactggtcatcgaatgcatcttcagacagtttatccacgttcgccaggaagtctgcttcctgaacgccagcttcacggatagatttcggaatacccagttcagctttcagcgtttccagccatgccagcagtttctcgatcttagcagcagtacggtcgcccggtgcgctcagacccaagtggtcggcaatttcagcataacgacggcgagcctgcggacggtcatactggctgaatgcagtctgcttggtcgggttgtcgttcgcattgtagcgaataacgttacaaatcagcagggcgtttgccagaccgtgcggaatatggaactgggaacccagtttgtgcgccattgagtgacatacacccaggaaggcgttcgcaaacgcgatacccgcgatagtcgctgcactgtgaacacgttcacgcgctaccggatttttagacccttcgtggtaggacgctggcagatattctttcagcagtttcagtgcctgcagagcctgaccatcagagaactcagatgccagtacagaaacataagcttccatggcgtgagttactgcgtccagaccaccgaaagcacacagggacttcggcatgtccataaccaggttggcgtcgacaatcgccatatccggagtcagcgcatagtctgccagcggatatttctgaccagtagcgtcgtcagttacaaccgcaaacggagtgacttcagaacctgtaccagaagtggtggtgacagcgatcattttcgctttcacgcccattttcgggaacttgtagatacgtttacggatatccataaagcgcagcgccagctcttcgaagtgagtttccggatgttcgtacataacccacatgatcttcgcggcgtccatcggggaaccaccacccagcgcgataatcacgtctggtttgaaggagtttgccagttctgcacctttacgaacgatgctcagggtcgggtccgcttctacttcgaagaagacttcagtttcaacgcctgctgctttcagtacggaagtgatctgatcagcataaccattgttgaacaggaagcggtcagtcacgatgagcgcacgtttgtggccatcagtaatcacttcatccagcgcgattggcagggagccacggcggaagtagatagatttcggaagtttgtgccacaacatgttttcagctcgcttagcaacggttttcttgttgatcaggtgtttcggaccaacgttttcagagatggagttaccaccccaagaaccacaacccagagtcagggaaggtgcgagtttgaagttatacaggtcaccgataccaccctgagacgctggggtgttaatcaggatacgcgccgttttcattttctgaccgaagtaagaaacgcgagccggttggttatcctggtcagtgtacaggcaagaggtatgaccgataccgcccatagcaaccagtttctctgctttttctaccgcgtcttcgaaatctttagcgcggtacattgccagagtcggggacagtttttcatgtgcgaacggttcgctttcatcaacaacggtcacttcaccgatcagaatcttggtgttttctggtacagagaagcctgccagttcagcaattttataggctggctgaccaacgatagccgcgttcagcgcaccgtttttcaggataacatcctgaacagctttcagctctttaccctgcaacagatagccgccgtgggttgcaaaacgttcacgtacagcgtcataaacagagtcaacaacaacaacagactgttcagaagcacagattacgccgttgtcgaaggttttggacatcagtacagatgcaactgcacgtttgatatcagcagtttcatcgataacaactggagtgttgcccgcgcctacaccgatagctggtttaccggagctgtatgcggctttaaccatgcccggaccaccagtcgcgaggatcaggttgatgtctgggtggtgcatcagtgcgttagacagttcaacagaaggttgatcgatccagccgatcagatctttcggagcaccggcagcgatagcagcctgcagaacgatatcagccgctttgttggtggcatcttttgcacgcgggtgcggggagaagataatggcgttacgggtcttcagactgatcagcgatttgaagatagcagttgaagtcgggttagtggtcggaacgataccgcaaataataccgattggttcagcgatagtgatggtaccaaaagtgtcgtcttcagacagaacaccacaggttttttcatctttataggcgttgtagatatattcagaagcaaagtggtttttgatcactttatcttcgacgatacccatgccggattcggcaacggccattttcgcgagtgggattcgagcatctgcagcagccagagcggcggcgcggaagattttgtctacttgctcttgagtgaaactggcatattcacgctgggctttttttacacgctctacgagtgcgttaagttcagcgacattagtaacagccataatgctctcctgataatgttaaacttttttagtaaatcatctgctcgaatacgagagtatagtcagtgcggtgatgatttgcttaacctatgaaaatcaaaagcttactcgcgctcacactcactgtgatttactaaaagagtttaaacattagagttattatctctaatgcgtcacttccaggtggcgtaagcaagattactcacttctgggtactgattacgtgatccaaatcaaatttttgcaaagctgacacctttcagcatcgcttttcgccattatagctaacagttaataaattgtagtatgatttggtggctacattagcatgttttgcacaactagataacaataacgaatgatagcaattttaagtagttaggaggtgaaaaatgctgtcaaaaggcgtattgtcagcgcgtcttttcaaccttatttatggctaacattatccggcttttgcttcggagctaaccgtgattcagaccttttttgattttcccgtttacttcaaatttttcatcgggttatttgcgctggtcaacccggtagggattattcccgtctttatcagcatgaccagttatcagacagcggcagcgcgaaacaaaactaaccttacagccaacctgtctgtggccattatcttgtggatctcgctttttctcggcgacacgattctacaactttttggtatatcaattgattcgttccgtatcgccgggggtatcctggtggtgacaatagcgatgtcgatgatcagcggcaagcttggcgaggataaacagaacaagcaagaaaaatcagaaaccgcggtacgtgaaagcattggtgtggtgccactggcgttgccgttgatggcggggccaggggcgatcagttctaccatcgtctggggtacgcgttatcacagcattagctatctgtttggtttctttgtggctattgcattgttcgctttatgttgttggggattgttccgcatggcaccgtggctggtacgggttttacgccagaccggcatcaacgtgattacgcgtattatggggctattgctgatggcattggggattgaatttatcgttactggtattaaggggattttccccggcctgcttaattaattcctttcaaatgaaacggagctgccatgctccgtttacttcgtcattatttttactttgttcccgcgcagttatcaaaagcaaaaggaataggtaaaaatattcttctcaaattacagttagttataaggatttccttaactgcttctcctcaccatcatgttattttcgccacatcataatcctgggcttgctgaagaataattgaaatgatattattaattccactgcctttggtagaggaaagtgctaaataataatcaattgttaaattattgtgcatttcactactggaactgtaatcagaaaagatagacatgcttagccaatctctatttgattgaattgaaagatgtttgttaaggcatggatgcaagctatagattctgatacggtcaataaaagagaattgcttaacaattttgcaaaatgtattggcgagtaagaaccgcatttggtactttccgggcaaccgccagacgattctttattggtaatgagaataattaacaattaaagagcgtcgcgaaagaataatgtgtctcgacaggggagacacagtacgaatcgacataaggtgatcgtctgaatcaccagaataaataaagtcggtgatagtaatacgtaacgataaagtaacctgacagcagaaagtctccgagcctgtgcagggtcccaatccgggattacacatgctggttaataccagtaattataatgagggagtccaaaaaacaatgaccaacatcaccaagagaagtttagtagcagctggcgttctggctgcgctaatggcagggaatgtcgcgctggcagctgatgtacccgcaggcgtcacactggcggaaaaacaaacactggtacgtaacaatggttcagaagttcagtcattagatccgcacaaaattgaaggtgttccggagtctaatatcagccgagacctgtttgaaggcttactggtcagcgatcttgacggtcatccagcacctggcgtcgctgaatcctgggataataaagacgcgaaagtctggaccttccatttgcgtaaagatgcgaaatggtctgatggcacgccagtcacagcacaagactttgtgtatagctggcaacgttctgttgatccgaacactgcttctccgtatgccagttatctgcaatatgggcatatcgccggtattgatgaaattcttgaagggaaaaaaccgattaccgatctcggcgtgaaagctattgatgatcacacattagaagtcaccttaagtgaacccgttccgtacttctataaattacttgttcacccatcaacttcaccggtgccaaaagccgctatcgagaaattcggcgaaaaatggacccagcctggtaatatcgtcaccaacggtgcctataccttaaaagattgggtcgtaaacgaacgaatcgttcttgaacgcagcccgacctactggaacaacgcgaaaaccgttattaaccaggtaacctatttgcctattgcttctgaagttaccgatgtcaaccgctaccgtagtggtgaaatcgacatgacgaataacagcatgccgatcgaattgttccagaagctgaaaaaagagatcccggacgaagttcacgttgatccatacctgtgcacttactattacgaaattaacaaccagaaaccgccattcaacgatgtgcgtgtgcgtaccgcactgaaactaggtatggaccgcgatatcattgttaataaagtgaaagcgcagggcaacatgcccgcctatggttacactccaccgtatactgatggcgcaaaattgactcagccagaatggtttggctggagccaggaaaaacgtaacgaagaagcgaaaaaactgctggctgaagcgggttataccgcagacaaaccgttgaccatcaacctgttgtataacacctccgatctgcataaaaagctggcgattgctgcctcttcattgtggaagaaaaacattggtgtaaacgtcaaactggttaaccaggagtggaaaacgttcctcgacacccgtcaccagggtacttttgatgtggcccgtgcaggctggtgtgctgactacaacgaaccaacttccttcctgaacaccatgctttcgaacagctcgatgaataccgcgcattataagagcccggcctttgacagcattatggcggaaacgctgaaagtgactgacgaggcgcagcgcacagctctgtacactaaagcagaacaacagctggataaggattcggccattgttcctgtttattactacgtgaatgcgcgtctggtgaaaccgtgggttggtggctataccggcaaagatccgctggataatacctatacccggaatatgtacattgtgaagcactaatggcaatacgtggggcaggagtgtcctgctccacggtgtctgatttttatcgcattacagaaggcacaggccagaaggtagggcaatgttaaaatttattctacgtcgctgtctggaagcgattccgacgctatttattcttattactatttcgttctttatgatgcgcctcgcgccgggaagcccttttaccggcgaacgtactttaccgccagaagtgatggccaatatcgaagcgaaatatcatcttaatgatccgatcatgacacagtatttcagctacctgaaacaactggcgcacggtgatttcggtccatcgtttaaatataaagattattcggtcaatgacttggttgcatccagttttcccgtttctgccaaactgggagccgcagcatttttccttgcggtaatactgggtgttagtgctggcgttattgccgcattaaaacaaaacaccaaatgggactataccgtgatggggctggcaatgaccggggttgttatccccagttttgtggttgcaccattattagtcatgatatttgcgatcattttgcattggctgccgggcggtggctggaatggtggggcgcttaaattcatgatattgccgatggtggcgttgtcactcgcttatatcgccagtattgcgcgtattacccgtggctctatgattgaagtattacactccaattttattcgtactgcccgggcgaaagggttacctatgcggcggatcattttacgtcacgcattaaaacctgctctgttacccgtgctctcttatatgggccccgcatttgtcggcattattaccggttctatggttatcgaaaccatttatggtttgccggggattggacaactgttcgttaatggcgcattgaaccgtgactattccttagtgttaagcctgaccatcctggttggtgctttaaccattttgtttaatgccattgtcgatgtgctatatgcggttatcgacccgaaaatccgttactgatactggagctcgcgatgatgttaagtaagaaaaacagcgagacgctggaaaatttcagtgaaaagctggaggtcgaagggcgcagcttgtggcaggacgcacgtcgacgttttatgcataaccgtgcggcggttgccagtctgatagtgctggtgctgatcgcgttatttgtaatcctggcaccgatgctttcccagtttgcctatgacgatactgactgggcgatgatgtccagcgccccggatatggagtccggtcactactttggtactgactcatccggtcgcgacctgcttgtgcgcgttgcgattggcgggcgtatctcactcatggtcggtgttgctgcggcactggtggctgtggtcgtcgggacactttatggttcgctttccggttatctgggcggtaaagtggattcggtaatgatgcgtctgctggaaatcctcaactccttcccattcatgttcttcgtcattttgctggtgacctttttcggtcaaaacatcctgctgattttcgtggcgataggcatggtttcctggctggatatggctcgtattgtgcgtgggcaaaccctgagtctgaagcgcaaagagtttattgaggcggcacaagttggcggtgtatcgacatcgggcattgttattcgccacattgtgccgaatgtactcggtgtggtggtggtctacgcatcacttctggtgcccagcatgatcctctttgaatctttccttagcttcctggggttgggtacgcaagagccgttaagcagctggggtgcattgctgagtgatggcgcgaactcgatggaagtctctccatggttattgttgttcccagcgggattcctcgtggtgacgctgttttgtttcaactttatcggcgatggcttgcgtgatgccctcgacccgaaagatcgttaaggagtgcagccatgagcgtaattgaaactgcaactgtgccgctcgcacaacaacaggctgacgcactgctgaacgtgaaagatttgcgtgtcacctttagtaccccggacggcgacgtcacggcggtcaatgatttgaatttttccctacgtgccggagaaacgctgggtattgtaggtgagtctggttcgggtaaatcgcaaactgcatttgcgttgatgggcctgttggctgccaacggacgtattggcggatcggcaaccttcaatgggcgtgaaatcctcaatttgccagagcatgaactcaataaactgcgcgctgaacaaatctcaatgatttttcaggacccaatgacttcgttgaatccctatatgcgcgtcggtgagcagttgatggaagtgctgatgctgcataagaacatgagcaaagctgaggcgtttgaagagtcggtgcggatgctcgatgcggtaaaaatgccggaagcgcgtaaacgcatgaaaatgtacccgcacgaattttctggcggcatgcgtcagcgagtcatgattgcgatggccttgttatgtcgacctaagctgctgattgcggatgaaccaacaactgcgctggacgtcaccgtacaggcgcagatcatgacgctattaaatgaactgaagcgggaatttaataccgccatcattatgatcacccacgatcttgtcgtggtggcggggatctgcgacaaagtgctggtaatgtacgccgggcgcacgatggaatatggcaacgcgcgcgatgtcttttatcaacccgttcatccttattctatcggtttgctcaacgcggtgccgcgtctcgatgcggaaggtgaaacaatgttgaccatcccgggtaatccgccaaacctgctgcgattaccgaaaggttgcccgttccagccacgttgtccgcatgcgatggaaatttgtagtagcgcaccgccgctggaagagtttacgcctggccgtctgcgtgcttgctttaaaccggtggaggaactgttatgaatgctgtaactgaaggaagaaaagtcctccttgaaatcgccgatcttaaagtgcactttgaaatcaaagatggcaaacagtggttctggcaaccgccgaaaacgctcaaagccgtcgatggtgtcactcttcgcctgtatgaaggggaaacattaggtgtggtaggggaatcgggatgcggtaagtccacctttgctcgcgccatcatcggtttggtcaaggcgaccgacggtcatgttgcctggttaggtaaagagttgctgggcatgaaacccgatgaatggcgtgccgttcgcagtgatattcagatgattttccaggatccgttggcatcgctaaacccgcgtatgaccatcggcgagatcatcgctgaaccactgcgtacttatcatccgaaaatgtcacgccaggaagttcgcgagcgcgtgaaggcgatgatgctgaaagtcgggttattgcctaacctgattaaccgctatccgcatgagttctctggtgggcagtgccagcgtatcgggattgcgcgtgctcttattcttgaaccgaagctgattatctgtgatgagccggtgtcggcgctggacgtgtcaattcaggcacaggtggtcaacctgctccagcaattgcaacgtgagatgggattgtcattaatttttatcgctcatgacctggccgtggtaaaacacatttccgatcgtgtgttggtgatgtatctcggccatgcggtagaactggggacctatgatgaggtctaccacaatccactacatccttacaccagggcattgatgtcggcagtccccatacctgatccggatctggagaagaacaaaaccatccagttactggaaggggaattaccgtcgccgatcaacccgccttccggttgtgttttccgtacccgttgcccgattgccggtccagagtgcgccaaaacacgtcctgttctggaggggagtttcagacactccgtttcttgcctgaaagtcgatccgctttaaaaacaataagggctgacagttgtcagccctttttcacgctaaaagcgattatttattcccgccagatgatatggcaaagtttgtgatctttttcgcggcataacagaatgcgggcaaaaacatcgttgatttcaccatcttcactgtccgccagaccaatcaccacttcggcaaaaaagtccgggttcaaatcgaaatcaacatgttcctgccagtcttccgccggatcgaataactccgcgccgccgcgctcttcaaactgaagattgaacagcagaacatcagctggatcgagattgtcggcagccagttcgagaaaaatatcgtaggcctgttcaagcgtttcatcttcagtcaggcgattgtttagatccatatccatagttactacctgtttaacctctgttggcgacgttttacagcaacggactgaagaagtaaaacagtcgctcggcgacacgttgccataatggacgttttagccataaacgggcatcgagcagacgtgaacgcgaaatataatcgtcctgaacggcggcgaggtcagcaccaaaacctttatcgtcgattgccagggtaatctcgaaatttagccacagactacgcatatcaaggttaactgtgccaaccagacttagttcgccatcgaccagcacgctcttggtatgcagtaacccgccttcaaactgataaattttaaccccagcagccagcagttccgtaaagaatgcgcgactggcccagccgaccagcatcgagtcattttttcgcggaaggataatactgacatccaccccgcgctgcgccgccgtgcaaatcgcatgaagtaaatcatcgcttggcacaaagtagggcgtggtcatgatcaaatattcacgcgccgaataagccgcagtcaataatgcctggtgaatgagatcttccggaaagccggggccagaagcaattgtgtgaatggtgtgaccgctggcctgttcaaacggcataatattgacatctggtggtggcggcagaatacgttttccggtttcaatctcccagtcgcaggaataaataatccccatcgcggtggcgatagggccttccatacgcgccatcagatcaatccattgccctacgcccgcatcttgtttgaagtagcgaggatcgaccatattcatgctgccggtgtacgcgatgtaattatcgatcatgatcatcttgcgatgttggcgcaggtccatacggcgtaaaaacacacgcatcagattgacctttaaggcttcgaccacttcaataccggcattacgcattagctcgggccacgggctgcggaaaaaagccacactcccggcggagtcgagcatcaatcggcaatgaatgccgcgtcgcgcagccgccattaatgattcagccacctggtccgccatgccgccgggctgccagatataaaacaccatctcaatattatggcgcgcgagctggatgtcgcggattaacgcctgcatcacatcatctgactcggtcatcagttgtagctgattccctttgaccccagcgatcccctgacgacgctcgcaaagcttgaataatggcgcagcgacactgctattttcttcggcgaagatatgcttacaggctttaaggtcgttaagccattttgcggtggaaggccacatcgctctggcgcgctcagcgcggcgtttgcctaaatggagctcgccaacggcaagataggcaataattccgactaacggcagaatgtaaataatcaacagccaggccatcgcggagggaactgcgcgtcgtttcattagaatgcgtaaagttacgcctgcaatgagcaaccagtatcccagaatggccaaccaactcaccaacgtataaacggttgtcatagattagaaatccttttgaaagcgcattgttatgagtttacgcatatggattcatctggcaaataaaaacgcgggaaaagcactggtcagcgtcgggggtgggggtataatgaccattctgttattgcatagagtagttaacatgaagcggagtagaacggaagtggggcgctggcgcatgcagcgtcaggctagccgacgtaaatcgcgttggcttgaggggcaatcgcgccgaaatatgcgtatccacagcatcaggaagtgcattctaaacaaacagcgtaactcgttattgtttgcgatctacaatatctaaatgtactgggcaccattgcggtgcccaataagtttactcttccgtctttaaactctatttttgcgccgattctttactgtcagctttcgtttctagttcatcgttatcgctgaaaataccatgacctgagttcaacaacattgaaacgagcatatcattattaatctcttcaccatttaaaactcgcgccagaatttcgctgccaaacagttgcggtgagagaatgatatccggatgtaccatcttaatcttattcaggtttttgctatcactgacggcgagaactgttttgacatcactgctcatatcttttgccgagagtacaacaaacgcgttatctgcatcgttatcactcagcgccagaatggcccggcaacgatcgattcccgctttctttaatacagaactgtcattactgtcaccggggataacatcagcattatcgcctaagcgttgctcaagttgcttgatatcatcttcaggcaagttgctgataaccgttacgttttgtccgcgttgattcagttgcaggatcgtattgatggcgagaatcgaatgtccgcaaacaataaaatgatctttacgatgcattgtatgattgtttccttttacaagtttgttgaatcccccgcggataagcggaccaaaaattgaggtcatagatgtggcaaaaacggtaatgccggaaataatgaccgaaatagtgaacaatcgtgctgattcagaaacagggacaatatcgccatagccgacggttgacatggtttctatcgaaaaatagaacgcggtcatcaaactttctattcgcggattaaaaccttcgcttaaataaagcgcaccgtaggttgagtaaaacagtaatgtcgtgaaactaataaatgcaaaaattgtcccggctgcggcgctactgtgggagaagtctttgcgcagtatcagcaaaaacaccagcgtaaaaatgcaaaatccaatactaaatttcagccagggataaaaatgcagggtgtaaattagcgctatcaacaacaaaatgatactgattgcccatgcgagctttgcccggaacagtaagccaatggagttcaggacaagaaagacgccgagcataaagagtggggcgtttgccagcaaggagagatccaactctgaaaatgctttgatatggaaaatatcaagcaaattgaccgacataccatagattgttttaaaaataagcaatccatttaaaaagacggccagcgcgagaatgtcgtgccgaagggtcacccataaatttgttgctgtttgtttgaatgtagcccagtgactcactgatacctctgtaaccacaattttgtttaattatcttagcgtgcacattttctgaacatacatgcagcgcgtgaatgtgttaaacaatagtagatgactttatccgcagtaatcaaaggatttgagcgagcaactgtacctcaggaaaggtcatttttcctgaatatgctcacatcatataaagaaatacagataaagttattatctgcttgtggtggtgaatgcactgaccggctataaggaaaggccaaacaagaacacggttgcaaaaaccgtgcccttaaatattgaatctctattcagaacactttcttaaatggtttcactgaaacgtgttcatagactcctgccgctacgtacgggtcagcatcggcccaggcctgagctgcttccagcgattcaaattcagcaataacggttgagccagtaaatcccgcagcccctggatcgttactgtctaccgctggcattggaccagctgtcaacaaacgaccttcatcatgcagtaactgtaaacgtgctaaatgtgccggacgaacggaaaggcgtttttcgaggctatcagctttgtcttgagcgtaaataacatacaacacgggcacaactccttgttcgggaaagttgtaaagtacgttatttgaaagggcgaagatctgcaacggaaagatgatgtctttgttaaggccatgcataaagtaagggtaattacgccaaaaatgacattttcactgatcctgatcgtcttgccttattgaatatgattgctatttgcatttaaaatcgagacctggtttttctactgaaatgattatgacttcaatgacccttgatttacctcgccgcttcccctggccgacgttactttcggtctgcattcatggtgctgttgtggcgggtctgctctatacctcggtacatcaggttattgaactacctgcgcctgcgcagccgatttctgtcacgatggttacgcctgctgatctcgaaccgccacaagccgttcagccgccaccggagccggtggtagagccagaaccggaacctgagccgatccccgaaccgccaaaagaagcaccggtggtcattgaaaagccgaagccgaaacctaagccaaaaccgaagccggtgaaaaaggtacaggagcagccaaaacgcgatgtcaaacccgtagagtcgcgtccggcatcaccgtttgaaaatacggcaccggcacgcctgacatcaagtacagcaacggctgcaaccagcaagccggttaccagtgtggcttcaggaccacgcgcattaagccgtaatcagccgcagtatccggcacgagcacaggcattgcgcattgaagggcaggttaaagttaaatttgacgttacgccggatggtcgcgtggataacgtacaaatcctctcagccaagcctgcgaacatgtttgagcgtgaggtgaaaaatgcgatgcgcagatggcgttatgagccgggtaagccaggcagtgggattgtggtgaatatcctgtttaaaattaacggcaccaccgaaattcagtaagcagaaagtcaaaagcctccgaccggaggcttttgactattactcaacaggtaaggcgcgaggttttccttcaggatcaaccgcgacatacttaaataatgcttctgtcgctttatagcgttgcccaattggttcagacgctacttttttcacccacacttcaatattaatgctgaccgatgtcgtccctttctggacacagcgtgcatagcagcacaccacatcgccgaccgcaaccggccgtaagaaagtcattccttcaacccgcacagtcactacgcgaccgtgggcaatttcttttgccagaatagcgccgccaatatccatttgtgacattaaccaaccaccaaagatgtcaccattggcattggtatcggcgggcatggctaaagtacgtaaaacaagatcgccctgagggacgttatgtgttgtagacatggtaaaaccgacttaaaaggaaaatcacaggcgcgatgctactatgattttcctgaggagaacagaggagatacagcgccagccccgaaggactggcagtctggttaggatttatcttcctgcggcatgtggcggtagatatagataccgcttaacaatgtgaagattaaggtaagggcggtcaggccaaagactttaaagttgacccaaatattttgcggcagccagaatgcgatgtagatgtttgccagaccgcaaaggataaagaaaacagcccaggccagattcagcttcgaccataccggttgcggcagcgtgagttctttacccagcatccgctgaattagcggctttttcatcacccattggctgactaacagggctcccgcaaatagagcataaatgacagtaaccttccatttaataaactcatcattgtggaagaacagcgtcaagccaccgaagacgaccaccagaacaaaagtgatcagggccatcttctcaaccttacgaaagcgaacccagctatagataagcacaatcgccgtggcgacgatcagcgccgcagtagccgcatagatgtcataaatcttgtaaaacgcgaaaaagacaaccagcggtaaaaaatcaagaaactgcttcattttacgattccgtaatcaaatgcttaaggttattggcgaatcaacatatacaggcggaacagatagatgagcaatatggctgaaatcaggttgctcaaggtgttcgccagtacggcaccaatttccggggttaatgcggcaaaagaagaggcaaaaagcagcaacagtgtttttgccagcaaccagctcagtactgcgggtgccaccagacgcatattcgcccaagtcagccgcatactgctacgcatcgaggcaaaaacgcccattttgtcctgtaccaacatcaccggtgccagggccagtaaaatggccatgataattcccggaacgaccaccagcatgatgccaatctgtactaaaagggtagtcagaaaaatcagaataaataactttggcaatatcggcgcactggcaccaatagctcgcagcgcactgactctctgacccgcagacaccagctggataattaatattacgcctccggcgagaatggcgttaccgattaatcctgaaaaagtggacgccgctgaagcctgcagcaaaatttgttgctgttccggtgacatattctgaaccaggtcgaacaacccactactgccgctaacgggcacgccgtcattgagctgcgcaagctgtgcatcactgggtgagaaaacatgccctaacaccactgtgataaacgcacatagcaacgataccaacagaatggtcataaattgattacggaagaaatttccggtgtcacggtatacggactgcgccgtgatagacatgcactctccttgagttttatgcaggtgttaattagcgggcaattgtaccctggttaagcctcgggtggcagcatcaggtcttgtatggaaaagcatatctttgtaaagcggaggtaattgctggccttcaggcatgggcaaatcgcggcaagtggcgaccgagttaatatttgcgtagcgaaaatatttaaaaattgatttaaatcacattaaccaggattctcaatgcaacttctaaattaatccagatcaataaagggtgaattatcatatgtaatgtgatctatgtaggatcatttgttactccaatgtaggtatattcgtcacgtttttataaccataacgacggagcggatatgaaaaagttaacagtggcggctttggcagtaacaactcttctctctggcagtgcctttgcgcatgaagcaggcgaattttttatgcgtgcaggttctgcaaccgtacgtccaacagaaggtgctggtggtacgttaggaagtctgggtggattcagcgtgaccaataacacgcaactgggccttacgtttacttatatggcgaccgacaacattggtgtggaattactggcagcgacgccgttccgccataaaatcggcacccgggcgaccggcgatattgcaaccgttcatcatctgccaccaacactgatggcgcagtggtattttggtgatgccagcagcaaattccgtccttacgttggggcaggtattaactacaccaccttctttgataatggatttaacgatcatggcaaagaggcagggctttccgatctcagtctgaaagattcctggggagctgccgggcaggtgggggttgattatctgattaaccgtgactggttggttaacatgtcagtgtggtacatggatatcgataccaccgccaattataagctgggcggtgcacagcaacacgatagcgtacgcctcgatccgtgggtgtttatgttctcagcaggatatcgtttttaattccgcacaaaaacgaccccgtaatatacggggtcaataaggacatggtataaagggtattatttcttcgcttctacgccatcagtttcagagcgaattaaaaatttctcagttgtttgcggaatattctgaatcagccagtcggccatttgcttttcctcatttaaaatcgcttcgatggttggaattgaagctgtatcaccggcattttttgctgctgctaatagtgaggtgtaacaggcgatttcaaattgctcgaagacatatccgctaatagagcctttgactatttcatcagaagggaatataccaccgattgactgcccaagcgcagccattttactcatggaatctttaatgactgaacgtgaaatgtcattacgatcaagaatagtttccagttgaacaatctggtttttggtttcactaagatgttgttcaatacgagcgcgtagttcaggataattatctatacggctggccatggattcaagcatagattcggcttgcttttccattgcgtgggcgtcacgtaaccagtcatgataatgttcaatacgattcatgaaaatgtcctctttataaaatgactaaaagttaaaattcatatttcaggctttattttcggctttcttatttacgttattaatggccagatcagtcagtttgatgtcggtggccttttcttcttccagggtttctttcagaagcttcgctgctttacggtaacctaattgttcagccagcgtcgctaatgtcccgtaactggcaatctcataatgctcgactttctgtgctgcggcaatcagtgcggcatcacgcacttcgtttttctcggtactttcgatgacctcattagcttcttcaataagaccttccattgccacacatttcatgcgcttaattttcaggttcgattcggactccacaacttgatcaatacgttcaatctgtccatgagtttcctcgaggtgcgcatgaaaagcctgacttaatttttcatttgatgttgctcttgcgagttttgccagtgcccgggttaattgtttttctgcgctgtaggtatctgaaagcaggtgaataaatacatcttcaatggtcttcatattcatatttttctccagtgaaatcactgcgagccatacggcccgcagatgcaattatctttatcagctgatattaataattaacggtgaatcaggatttgcctgatttattaccaccgctttgttgaccgccttttttacccgcttcagatgcgcgttgcggatcatttttaaaattaccgccgctatgctgaccgcctttacggcctgcgtcggatgccttctcacggtcttcggcgaaatttcctgaaccaccacgatgttcggccatgttatttctcccgttgcgttgcattgtttcattaatatgagtgttgtgtgtcgacactcattaaaattagtcgctaatgagaattagtcaaattaagcgcaacgagaagatagagggaaaatatattttgaggaacattctggatatattaacaattacctgaggaataagtgacttagagaaaattattgattttactggtgttatgttgcgggattaatttgtttgattatattactgttgggcggaaaaatgacgtaagttgacgttcgaccggggtaagcgaaacggtaaaaagataaatattaaatgaatttaggatttttccggcttcattaaagaaagttaaaatgccgccagcggaactggcggctgtgggattaactgcgcgtcgccgctttcatcggttgtacaaaaactttcagtgccgccagcattttctctggctcattaatatgttgctcgatgattttaacaatggccgaaccagaaatcgcgcccgcagctcctgcatcaatcgctgcttttacctgatccggggcggaaataccaaatccctgcaatggaggtgcagcgttgtactctttcagcttcgcaaccagatgattgaggggtaacgcggcgcggttttctgcgccggtcacgcctgctcgtgacagcaaataggtgtaaccacgaccgtaagaggctatctggcgcagcaggtcgtcatcggcatttggcgggcagatgaagataggtgcgacattatgacgcaacgcggcctggcggaagggcgcggactcttcaactggcacatcggcaaccagcaccgaatcgacgccgactttttcgcactgggcataaaactcatcaatgcctttgttaaacaccagattggcatacatcaacaggccaatgggaatggtcgggtgtttctggcgaatcagtgccagcatttcaaaacattgtgccggagtcacacctgccgcaaaggcgcgcagagtggcgttttgaatcgtcgggccatccgccagtgggtcggagaaggggatacctaactccagcgcgtcagcaccggcttcaattagcgtatcgataattttcaatgactgctcaatgcccggatcaccgagcgtgacgaaaggaacgaatgcgccttctttgcgctccttcaactgggcaaacagagattcgtagcgttccatcagatttcccctcgtgctttcaaaatatcgtgaacggtgaagatgtctttatcgccgcgaccggaaaggttaaccaccagtagctgctctttatccgggttttcgcgcatcattttcaacgcatgggccagggcgtgggaggattccagcgccgggatgatcccttcgtgcaggcacagcgttttgaaggcttcaagggcttcatcatcggtaatagacacgtaatcagcgcgtccagtgctgttaagatacgcgtgttgtgggccgacagacgggaaatccagtccggcggagatggagtaagattcttcaatctgcccgtcttcggtttgcatcatcggcgctttcataccgaaatagatacccacgcgaccatgttttagcggtgcgccgtgctcgccagtttcgataccgtgaccacctggctccacaccaatcaggccgacgttggtttcattgatgaaatcagcaaacatgccgatggcattcgaaccgccgccaacacaggcgataacggcatccggcaggcgaccttctctttccagaatctgcgctttggtttcttcgccaatcatccgctgaaactcacgcacaatggtcggataaggatgcgggccagctgcggtgcccagcatatagtgcgcggtttcgtaactaccggaccagtcgcgcagcgcctcgttacaggcatctttcagcgtcgcggaaccgctatgcaccgggatcacttccgcacccattaagcgcatacgaaaaacgttaggcgactggcgttcaacgtctttggcacccatataaatacggcatttcaggccgagcagggcgctggcaagggccgacgccacgccatgctgaccggcaccggtttcggcgatgatttcggttttacccatccgcttcgccagcaacgcctgccccagcacctggttagttttatgcgcgccgccgtgcagcaaatcttcacgcttgagatacagcgtggtgttcgtcccggctgtaatgttctggcatttggtcagcgcggttggacgcccggcatagtttttcagcaggtcgttgaactgagcctgaaattcaggatctttttgcgcactgacaaaagcttcttccagctggcgcagagcaggcatcaggatttgtggcacgtacatgccgccaaactcaccaaaataggggttaagtaatgttgtcattgttcctttccttaatatgcgcgcagcgtctggaaaaccgaggccaaaagacgtgcgtctttgatgcccggttgcgactctacagcagaattaaaatcaagtccggcgcagccggtttgtgccgcttccacgcagttatctgcgcctaagccccccgccagcagaacgttgccaagcgattgaccatttaatagtgaccagtcaaaacgttgcccgcttccaccctggccgttgtctaaaacatatttatcaacgtgctgaaactcgcgggcgggcagggtttcaccgacgcttaatgctttccagatggcaacatgtgctggcagagcttcacgcagcgtatcgatatacagctgttcttcattaccatgcagttgcactgccgccagcgataacaccttagctttgtccaccacatcggcaatatcgtgattgcggaacacgccaacatactgcaacggtgccgcagccatcacttcctgcgcctgttcaacgttgacgcaacgcggtgatgtcgcaacaaaaatcaacccaccgtaaatcgcgcccgcgtcataagctgctttagcatcttgcccacgcgtcaggccacatactttattctcacccagcaacacccggcgcacggcggcgtgcaaatcgtcatgggccatcaacgccgaaccaatcagaaaaccgttagcgaagtggcttaactcgcgcacctgagcgtaagtattgatgccggattcgctgattaccgtcacgttgtgccccagtttcggcgcaagctcgcgggtacggttgagatcaatcgacaaatcacgcagatcgcggttgttgatgccaacgacctttgctcccaatgcaatggcgcgctcctgttcctcttcattactgacttcggtcagcacccccatctccagactgtgagcgacggcggcaagctggcgatattggtcgtcatccagtactgaaagcattaataagcaggcatcggcctggtaatagcgcgccagatagatctggtaagggtcgataatgaagtctttacataaaatcggctgcggggcgatttggctgacgatggggaggaaattaaagctcccctgaaaatatttctcatcagtcagcaccgaaattgccgaagcgtaatgtttataaatggcggcaatgcgtgctggatcgaaatcatcacggatcacgccttttgacggcgacgctttcttgcactccagaataaacgccgtgcgcgcaccctgtagcgcatcataaaaatgtcgcgtgctcggctgaacctcattctgaaaactggccagcggttgctgctgtttgcgggcttctacccaaatcgccttgtctgcgacgattttcgctaaaacggtttgcatcatttaccctcgtgccgccagtgcggtgactctgtcgtaagcggaaccactgcgcagtacctcaagaacggtttgcgcattggcttgcagatcttcatggccatgcaggcgcattaacatggcgacgttcgcagcgacggctgcttcatgggcggcgtcgcctttaccttgtaacaaacgtgttaaaatgtcacggttttcttccggtgttccgcctgccagttgctcctggtggtagggtgtcaggccaaagtcttctgcggtgagctgatagcttttaatttcgccgtcatgcagttcggcaacgattgtcggcgcgtgtaatgaaacttcatccatcccgccgctgtgcaccaccgccgcgcgttgataccccagcacgcgcaaggtttcggcaatcggcagcaccagttccggactataaacaccaattaacgccagcggcggatgcgccgggttaatcaatggccccagcacattgaacagggtgcgggttttcagttgctggcgaaccggcatcgcgtggcggaatccggtgtgatacttcggcgcaaagaggaaacatacacctaactcatccagcgcctggcgcgatttatcggcgttcatatcaagattaataccgaacgccgccagcagatcggacgaaccagatttactggagacgctacggttgccgtgtttcgccactttcagcccacaggccgcggcgacaaacgcactggcggtagaaatattgatactgttgctgccgtcaccgccagtaccgacgatatcagcaaacagataatccgggcgcgggaacggcgctgcgttttccagtagcgcggttgctgccccggcgatctcgttcgggtgctcaccgcgaattttcatgctcaccagcgccgccgccagttgttccggcttcagctcgccacgcaccaccgctgaaaacagctggtggctttcttgttggctaagcgtctgcgcctgatacagtttttccagaatcggttgcagcgtgttggctggctctagtttctgctgcgcccaggccagcgtttgttccagcaggcgagcgccctgggtggtgagaatggattccggatggaactggaatccacaaacgcgatccgcatcgtgacgtactgccatcaccatgccattaaaatgggcgttgatggttaaaccggccggaatgttactgccaaccagcgagtgataacgcgccaccggcagcgggtttgttaatccggcaaacatcgcctgaccgtcatgttcaatgctggaggctttaccgtggagaatttcgcccgcctgaccgacatagcccccgtaagcttcgacaatcgcctgatgtccgaggcaaatgccaataatgggcagcttgccacgcaagcgggtgaggagttccggcatacaaccggcttcgctcggcacaccggggccaggagaaagcatcagcaccggattgctcatggtcgccaggcgttcaattaaggtttgcgccggaatatggttgcggtaaatcaccacgttatgcccattgctgcgcaactgatctgccaggttgtacgtaaaagagtcgatattatcgagcagcagaatgtcagccatcagaaagtctcctgtgcatgatgcgcggtggcaatagcgcgcagtacagcgcgggctttgttacgggtttcgtcggcttccgactgcggaacagaatcaaggactacaccagcacccgcttgcacggtggcgataccgttttccaccagcgccgagcggatcacaatgcaggtgtcgagatcgccatgcgcggtgaaataacctaccgcgccgccgtagctgccgcggcgacgaccttccgcctcggcaattaactgcatagcgcgtactttcggcgcaccgcttaacgtccccatattcatacaggcgcgataagcgtgcagggcgtcaagatcgtgacgcagttcgccgactacgcgagagacgaggtgcatcacataggaataacggtcaactttggtgagatcggcgacgtagcggctgccgggggtgcaaatgcgtgccagatcattacgggcgagatcaaccagcatcagatgttcagacagctctttatgatcggtacgcatttccagttcaatacggctgtcgagatctctgtccagtgaaccatcggcgcgacgaccgcgtgggcgtgttccggcaatcgggtagatctcaatctggcggctggtggcatcatacttgagcgagctttccggcgacgcgccaaatagggtgaaatcattatcctgcataaaaaacatgtacgggctgggattactctttttcagcacgtaataggccgccagcggtgacgggcagggcagagagaaacggcgagatggcaccacctggaaaatttctccagcgcgaatcgctttttgcaacaaacgcactacgccaccgaactcttcatcgctctgattacattcacaacgcatatgcggcacggaaaccactggcagcggcggcgcggcttcggtcagttgctgacgtagttcgttcaggcgagcagtgagacgttgtttttcttcttcattcggagcaaacaggctggcctgaatacgggtgctttttttctgatggtcaatcaccatcagcgtttcagcgagataaaaacagaaatcagggcagttattttccgctgacagttgcggtaaatcttcaaatcccgccacaaggtcataagagaacaggccgccgaagaacatggcttctcgttcttccttcggtacattcaacagattctgcaataaacggaaagcgtcaaaaaccgaaagggagcataagcgggcgtcttcatccagcagtggactgacaggggggaagcgcagcacacggcagtttggtgattgttcactttccacacccgcaggcagggcgttatccagtagtgccaggagggcttcgccgttgccggaaagtgcctggattgtgacagtgtcacctaaagctgtaatgcgcagcgcactgtctaccagcagcaggctttttaaatcatctttgctgtcgatatctgcggattccagcagcagcgttgccggacgatccccacacaactggtgaaaaagcgcggtgggattgtcgcgataagcgccttcgcaggttagcagttcgagagtcggtttttgtgtttgcattgttattctctaattttgttcaaaaaaaagcccgctcattaggcgggctgggtatctgattgctttacgcatggtgaatacactgcccgtttcaggaagtgcgccaccaacctttcagtacgaaaattgctttcattgtcgataccctttttacgtgaacttgcgtactagttaactagttcgatgattaattgtcaacagctcatttcagaatatttgccagaaccgttatgatgtcggcgcaaaaaacattatccagaacgggagtgcgccttgagcgacacgaattatgcagtgatttacgacctgcacagccataccacagcttccgatggctgcctgacgccagaagcattggtgcaccgtgcagtcgagatgcgcgtcggcaccctggcgatcaccgaccatgacaccacagctgcaatcgcgccagcaagagaggaaatttcacgttcgggactggcgttgaatcttattcccggcgtggaaatttccacggtctgggaaaatcatgaaattcatattgtcgggctgaatattgatattactcatccgctaatgtgtgagttcctcgcgcagcagacagaacggcgcaatcagcgggcgcagctgattgccgaaagacttgaaaaagcgcaaatacctggggcgctggaaggcgcacaacgactggcgcagggcggcgcagtgacgcgcggtcattttgcgcgtttccttgttgagtgcggcaaagccagttcaatggcggatgtctttaaaaagtatctggcgcgcgggaaaaccggatacgttccgccacagtggtgtacaatagaacaagctattgatgtcattcatcattctggcggtaaggcggtgctagctcatcctgggcggtacaatcttagtgctaaatggctgaaaagattggttgcgcattttgccgaacaccacggtgacgcgatggaagtcgcgcagtgccagcaatcgcccaatgaacgtacccagctggcggcccttgcgcgtcagcatcatttatgggcatcacaaggatctgattttcatcagccatgcccgtggatcgaactgggtcgtaaactctggctgcccgcaggcgttgaaggcgtctggcagctatgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgttgataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaaccctatcgctcaggcgttacttgaagcattgggcgaaccgatgctttccacttcgctaatgctgccaggcagcgaatttaccgaatcggacccggaagaaattaaagatcgtctggaaaaacaggtagatttgattattcacggcggctatctcgggcagaaaccgacaacggttattgatcttaccgatgatacgccggtcgtggtgcgtgaaggcgtaggtgatgtgaagcctttcttataacaaattgcgttccacggatggaagactatggcagggaagtttcgctgcattttgctgttgatagcagggctgtttgtatcatctctaagttatgcagaaaacacggagatcccttcttatgaagaagggatctcgctctttgatgttgaagccactctgcaaccagatggggtgctcgacatcaaagaaaatattcattttcaggcgcgaaatcagcagattaagcacggcttttatcgtgatttaccacgactatggatgcagcctgatggggacgctgcactgctgaactatcatattgttggcgtcacccgtgatggtattcctgaaccctggcatcttgactggcatatcgggttaatgagtattgtcgtgggcgataaacaacgtttcttgcctcaaggcgactatcattatcaaattcattatcaggttaaaaatgctttcctgcgtgagggggattctgatctgctaatctggaacgtgaccggtaaccactggccgtttgaaatttataagacccgtttttctctccagttctctaatattgcgggtaatccatttagcgaaatcgatctttttaccggagaagagggcgacacatatcgtaatggccgcatccttgaggacggaagaattgaatcccgcgatccgttttatcgtgaagatttcacggtcctctaccgctggcctcacgctttacttagcaatgcctcggctccgcaaacgacgaatattttcagccatcttcttttaccctccacgtcatcgttgttaatttggtttccgtgtctgttcctggtttgtggatggttatatctctggaagcgcaggccgcaatttacgccggtagatgtgattgaaaccgatgtcattccgccagattacacgcccggcatgttacgtctcgatgcgaagctagtttacgacgataaaggtttttgtgccgatatcgtaaatctgattgtgaaaggaaaaattcatctggaagatcagtctgacaagaaccagcaaatcctgattcgtgttaatgaaggcgcgaccagaaataatgcggtattactgcccgcagagcagttattactggaagcgttatttcgtaaaggcgataaggtcgttcttacggggagacgcaacagagtcttacgcagggcatttttacggatgcagaaattttatctgccgcgtaaaaagtcttcgttttaccggtctgatacttttttgcaatggggtggactggcaatattggcggtcattctttacggtaacttgagtcctgtaggctgggcaggaatgagtctggtgggcgatatgtttattatgatctgctggattattccttttttattttgttcccttgagcttttgtttgcccgcgatgatgacaagccttgcgttaatcgtgtaatcatcactttgtttttaccactgatttgttcaggcgtggccttctattctctctacatcaatgtcggagatgtattcttttactggtatatgccagcgggttattttaccgctgtttgcctgaccggttatctcactggcatggggtatatttttctgccaaagtttacccaaactggacagcaacgttatgcccacggtgaagctatcgttaactatcttgcgcgtaaagaggcagcaacacacagtggacgtcggcggaaaggggaaacacggaaactggattacgcgttgctaggttgggctatatcggcaaatttggggagggaatgggcgttacgcattgccccttcgctttcttcggcgattcgcgctccagagattgcccgtaacggcgttttattctcattacagacgcacctaagttgcggggccaataccagtttgttggggcgaagttattccggtggtggtgctggcggcggcgcgggtggcggaggcggtggtggctggtaattaagctgatgttaatcgaaacaagctttaaccataaagatagtgtagtatgttgcgcctcaaagccaggccgataaacgtcgagtcgtttacttaaggcctgaagagttcaaacagactttactatcagtgagtcagatgtaagttctgactcactgttgcacaaaagcatatcagacgcctgggaaggcgacaccaaaaggaagctctatgagcgaaaagctacagaaagtgctggcgcgtgccggccacggttctcgccgtgaaatcgaatctattattgaagccggtcgtgtgagtgttgatggcaaaattgctaaactcggcgatcgtgttgaagttacccctggattgaaaatccgtatcgatggtcacctgatttcggtacgtgagtccgctgaacaaatttgtcgcgttctggcctattacaaaccggaaggtgagttgtgtacccgtaacgatccggaaggacgtccaacggtgtttgaccgtctgccaaaactgcgtggcgcacgctggattgccgtgggtcgcttggacgttaatacctgtggtctgctgctgttcaccaccgatggtgaactggcaaaccgtttaatgcacccaagccgtgaagttgaacgtgaatatgccgtgcgtgtatttggtcaggttgacgacgcgaaactgcgtgatttgagtcgtggcgtgcagttggaagatggtccggcagcttttaaaaccatcaagttcagcggcggcgaagggatcaaccagtggtacaacgtgactctgaccgaaggccgtaaccgtgaagttcgtcgtctgtgggaagcggttggtgtgcaggtgagccgcctgatccgtgttcgttacggtgatatcccactgccaaaaggtctgccacgcggtggctggacggagctggacctcgcccagactaactatctgcgcgaactggtggagctaccgccagaaaccagctctaaagtcgctgtagaaaaagaccgtcgtcgcatgaaggcgaatcagattcgtcgtgcggtgaaacgtcacagtcaggtgagcggcggtcgtcgttctggcggacgtaataataacggttaatcaaagtatgccggacgtcatatccggcatttttacagattaataatcgatccctatctgcgcttttacaccggcatcaaacgcatgtttgacggggcgtaattcacttaccgtatctgccagttcaagaatatcccgatgacaaccacgacccgtgataatcaccgtctgttgatgtggacgttcatttaacgcctgcaccacttcttccagtggcaaatagtcatacgccaccatatacgtcagttcatcaagcaaaaccatatccagtgaggaatcagcaagcatccgctttgcatgttgccagacttcgcggcaggcggcggtatcagactcgcggttttgtgtatcccaggtaaagcccgttgccatcacctgaaactcaacgccatgtggctccagcagattgcgttcgccattaggccaggtgcctttaataaactgcacgacgcctactttttttccgtgaccaactgcgcgtgttgccgtaccaaatgccgcggtggttttgccttttccattgccggtaaagacgatgataataccgcgttcatcctgggcctgggccacacgagcatctactttttctttcactcgctgctgacgctgttggtagcgttcatcactcattgggaaattcctggtttacggcccggttgggcgtcaaaggtcatgccggttttacggcggctgtcatcgcccatcagccagaggtagagcggcatgatatcagcgggtgttttaagtttctgtggatcttcggtcgggaaggcgctggcacgcattgcggtgcgcgtaccgcctgggttaatgcagttgacacgcaggcgctgctgatattcatcggccagtacctgcatcatcccttcggtggcaaatttcgacgctgcatatgcaccccagttggctcgtccctgacgtccaacgcttgatgaagtaaagaccagtgaaccggcgtccgatttgagtaataaaggaagcagtgcctgggtgagcataaaggtggcattaacgttgacctgcatgacgtcctgccagacctgcggattttgttcgctcattgggcaaacatcgccgagcaatccggcattatgcaaaacaccatccagacgcggataattaacggcaatgcgctgtgccagttgttggcaattttcggacgtgcaggtcagcaaatcgagaataaaccactgtggctgacgcccagtttcttcgtttatgtggctggctacctgacgtaatttttcttcattacggcccaacagaatcactgtcgcaccatagcgtgcatacgtcatcgcggcttcacgaccaataccatcgctggctcccgtcaccaggataatgcgatcattgagtaaatcttgttttggctggtaatgcatggctactcctcaacgacgttgtctgtcgcgctgccagtgtactttatgactttggggctttatgcctgaaacagaagggcatttcaatcagcctggggcgataacaccgcaaaatggatactttgtcatactttcgctgcaataacatctctgcgagacggcttaacatgcctgttgtaaactgtgagccaaagcgttgtttaaccaaggtggggactcgtggaattgttgtctgaatatggtttgtttttggcgaaaatcgttaccgttgtgctagcgattgcggcgattgccgccattattgtcaatgttgctcaacgtaataaacgccagcgtggcgagttacgggtcaacaatctcagcgaacagtataaggagatgaaagaagaactggccgcggcgctgatggactcacatcagcaaaaacagtggcacaaagcgcagaagaaaaagcataagcaagaagcgaaagcagcaaaagcgaaagccaaactgggcgaggtggcaactgacagtaaaccccgcgtctgggtgctggattttaaaggcagcatggacgcccatgaagtgaactcgctacgtgaagagataacggctgtactcgcagcattcaaaccgcaggatcaggttgtgctccgtctggaaagccctggtggcatggtgcatggttacgggctggcggcttcgcaactgcagcgtctgcgcgataaaaacattcctttaactgttacggtagacaaagtcgctgccagcggcggttacatgatggcctgtgtggcggacaaaattgtttccgcaccgtttgctattgtgggttccattggcgtggtggcgcaaatgcccaactttaaccgcttcctgaaaagcaaagatattgatatcgaactgcacactgccgggcagtataagcgcacgctgacgttgctgggtgaaaataccgaagaagggcgggagaaattccgcgaagagttgaacgaaacgcatcagttgtttaaagattttgtgaagcgtatgcgtccttctctggatattgaacaggtggcaacgggtgaacactggtacggacaacaggcggtagagaaaggcctggttgatgaaatcaacaccagtgatgaagttattcttagcctgatggaaggccgtgaagtggtcaatgtacgctatatgcagcgtaaacgactcattgaccgattcaccggcagcgcggcagagagcgccgatcgattgttgctacgctggtggcagcggggtcaaaagccattgatgtaaaagacaaacgcgaggctaagacctcgcgttttgctttaatcaaccagatgatatttttctgaaagcacatgggccaggtgtttgaacatattaaacaccgcggtgcttttggctgttggcaatccttgttcatctaaaaagtagtcgccggtaaataccagcacgccattacgctgcgtgacgccggtggcttcaatccctgcgagcgtatcctcatgctcacgaatgattttgttggcctctttcaacagcgtttcgcggtcgatgggttgtgtctctttgttcattatttactccttaaacaaggacattagtctacgccaggcatggcttgcagacaaatataccacgctggtggcaagagcgccttactggcaactttggattttgcatgctaataaagttgcgtatcggattttatcaggtacagtgtgacgctttcgtcaatctggcaatagatttgcttgacattcgaccaaaattccgtcgtgctatagcgcctgtaggccaagacctgttaactcagtcacctgaattttcgtgaacagagtcacgacaaggggttgatatccgcagagagcgagtccatatcggtaactcgttgccagtggaaggtttatcaacgtgcgacgcattcctggaagaatcaaattaggtaaggtgaatatgggtaaagctcttgtcatcgttgagtccccggcaaaagccaaaacgatcaacaagtatctgggtagtgactacgtggtgaaatccagcgtcggtcacatccgcgatttgccgaccagtggctcagctgccaaaaagagtgccgactctacctccaccaagacggctaaaaagcctaaaaaggatgaacgtggcgctctcgtcaaccgtatgggggttgacccgtggcacaattgggaggcgcactatgaagtgttgcctggtaaagagaaggtcgtctctgaactgaaacaactggctgaaaaagccgaccacatctatctcgcaaccgaccttgaccgcgaaggggaagccattgcatggcacctgcgggaagtgattgggggtgatgatgcgcgctatagccgagtggtgtttaacgaaattactaaaaacgcgatccgccaggcatttaacaaaccgggtgagctgaatattgatcgtgttaatgcccagcaggcgcgtcgctttatggaccgcgtggtggggtatatggtttcgccgctgctatggaaaaagatcgctcgtggcctgtctgccggtcgtgtgcagtcggtggcggttcgcctggtggtcgagcgtgagcgtgaaattaaagcgttcgtgccggaagagttctgggaagtcgatgccagcacgaccacgccatctggtgaagcgttggcgttacaggtgactcatcagaacgacaaaccgttccgtccggtcaacaaagaacaaactcaggctgcggtaagtctgctggaaaaagcgcgctacagcgtgctggaacgtgaagacaaaccgacaaccagtaaacctggcgctccttttattacctctacgctgcaacaagctgccagcacccgtcttggatttggcgtgaaaaaaaccatgatgatggcgcagcgtttgtatgaagcaggctatatcacttacatgcgtaccgactccactaacctgagtcaggacgcggtaaatatggttcgcggttatatcagcgataattttggtaagaaatatctgccggaaagtccgaatcagtacgccagcaaagaaaactcacaggaagcgcacgaagcgattcgtccttctgacgtcaatgtgatggcggaatcgctgaaggatatggaagcagatgcgcagaaactgtaccagttaatctggcgtcagttcgttgcctgccagatgaccccagcgaaatatgactccacgacgctgaccgttggtgcgggcgatttccgcctgaaagcacgcggtcgtattttgcgttttgatggctggacaaaagtgatgcctgcgttgcgtaaaggcgatgaagatcgcatcttaccagcagttaataaaggcgatgctctgacgctcgttgaacttacaccagcccagcactttaccaagccgccagcccgtttcagtgaagcatcgctggttaaagagctggaaaaacgcggtatcggtcgtccgtctacctatgcgtcgatcatttcgaccattcaggatcgtggctacgtgcgagtagaaaatcgtcgtttctatgcggaaaaaatgggcgaaatcgtcaccgatcgccttgaagaaaatttccgcgagttaatgaactacgactttaccgcgcagatggaaaacagcctcgaccaggtggcaaatcacgaagcagagtggaaagctgtactggatcacttcttctcggatttcacccagcagttagataaagctgaaaaagatccggaagagggtggtatgcgcccgaaccagatggttctgaccagcattgactgcccgacttgtggtcgcaaaatggggattcgcacagcgagcaccggggtattccttggctgttctggctatgcgctgccgccgaaagagcgttgcaaaaccaccattaacctggtgccggaaaacgaagtgctgaacgtgctggaaggcgaagatgctgaaaccaacgcgctgcgcgcaaaacgtcgttgcccgaaatgcggcacggcgatggacagctatctcatcgatccgaaacgtaagttgcatgtctgtggtaataacccaacctgcgacggttacgagatcgaagagggcgaattccgcattaaaggttatgacggcccgatcgttgagtgtgaaaaatgtggctctgaaatgcacctgaaaatggggcgtttcggtaaatacatggcctgcaccaacgaagagtgtaaaaacacacgtaagattttacgtaacggcgaagtggcaccaccgaaagaagatccggtgccattacctgagctgccgtgcgaaaaatcagatgcttatttcgtgctgcgtgacggtgctgccggtgtgttcctggctgccaacactttcccgaaatcgcgtgaaacgcgtgcgccactggtggaagagctttatcgcttccgcgaccgtctgccggaaaaactgcgttatctggccgatgcgccacagcaggatccggaaggtaataagaccatggttcgctttagccgtaaaaccaaacagcaatatgtctcttcggaaaaagacggaaaggcgactggctggtcagcattttatgttgatggcaaatgggttgaaggaaaaaaataacctttaattctgtcaggtttttataaacaaagggtcgcgaaagcggcccttttttattgcatattattttttcttcacacctatacactaaggctataaatgatatagtggttatagttagcaccttttttattattaaatcgtattagtcacccgccaggtgtgacgaaaaaacgatgttctgatggcgtctaagtggatggtttaacatgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcagggcaagaaataattcgtatcgctcgcgaagtcctgtcgaaagtcgatgccataaaatcggttgccggagagcacacctggccggataaaggttcactgtatatcgccaccacgcatacccaggcacgctacgcattaccaaacgtcatcaaaggctttattgagcgttatcctcgcgtttctttgcatatgcaccagggctcgccgacacaaattgctgatgccgtctctaaaggcaatgctgatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttaccggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatcccgaccttgtgcgtgttgatgctcacgatatcttcagccacagtacaaccaaaattggttttcgccgtagtactttcttgcgcagttatatgtatgatttcattcagcgttttgcaccgcatttaacgcgtgatgtcgttgatgcggctgtcgcattgcgctctaatgaagaaattgaggtcatgtttaaagatataaaactgccggaaaaataatttcttgcgttattttcggcaccttttatgtagcgaaggtgccggaatatattctcttttgttacttatttctataccgtgcacaatatttttatccctcatatttatagggtaaattacctgtaaagtagtgtctaattacccgcctcgcaaactccagttttcaaatatctatttcaggtcaaaagattgaattattcactggagacgattcgtaaattcgctggatttttgactaaagtttctttaggatttgtctcatcgtatgattaattacaccaatcgttcaacgtcttgctgataagtgatggcgattatatgaggttagcaatgccttctggaaatcaggaaccccgccgcgatcctgaattaaaacgtaaagcctggctggcggtttttcttggttctgcacttttctgggtggttgtcgcactgctgatttggaaagtgtggggataactatggtcggtcaggagcaactggagtcgtcaccattatgccagcatagtgacaatgaaacagaaacgaaacgggaatgttccgtcgttattccagacgactggcaactaacatcgcagcagcaagcctttatagaactgtttgctgaagatgatcagccgaaacaataattatcatcattcttattacccatttttaatgaattaaagggcttttaatacaccgcagcaataacagcttgagttatctcaacacaaaataataaccgttaagggtgtagcctatgatcaacacaaatatgaaatattggtcctggatgggcgcgttttctctgtcgatgctcttctgggccgaactcctctggatcattactcactgatccttgaccccgctgcggcggggttgtcatttgctttgccacaaggtttctcctcttttatcaatttgggttgttatcaaatcgttacgcgatgtttgtgttatctttaatattcaccctgaagagaatcagggcttcgcaaccctgtcattaaggaggagctatgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaacaactatttgcttgccggttattttgcttccggcaagcaaatgaattacacaatgcaagagggttatttgttcagcaaatggcccattttctcggctttggtatcgagataatgttcgttattggggttacgacctacaatcaatggtacgcgttcaacaatattaatccctgcttcggtcagaatttcgacttttttcgggttattggttaacaagcggacttcattgacgccaaggagtttgaacatatcagcgcaaagagtgaagtcgcgctcatcagcggcgaagcctaactggtggttagcctctacggtatcgtaaccttgatcctgcagtgcgtaagcgcggattttattcagcagaccaatgttacgaccttcctgacggtgatacagcaaaataccacggccttcctcggcaatttgcgtcaatgccgcttcgagctggaagccacaatcgcagcgcaagctgaacagggcgtcaccggtcagacattcggaatggacgcgcgcaagtaccggggtatgcccggaaatatcgccatagactagcgcgacatgatcgtgtccggttgccagttcttcaaatcccaccatcaggaaatcgccccatggggttggcagtttggcttctgccacacgtttaagctgcatgaaattctccagataatgctggttctgtattggcttattttgccataacgagaaggggttcacctaatcacgacgcgtcgatcgttcacggaatggcacaaatctgtcaatttttcctggaactggcgttttcagttatgattgtgggacttatcaaaaaggagaggccatgcgttcgattgccagacgtaccgcagtgggagctgcactattgcttgtcatgccagtagccgtatggatttctggctggcgttggcaacctggagaacaaagttggctactaaaagcggctttttgggttactgaaactgtcacccagccctggggcgtcattacacatttgattttattcggctggtttctctggtgtctgcgttttcgcattaaggctgcctttgtattatttgccattctggcggccgcaatccttgtgggacaaggcgttaaatcctggatcaaagacaaagtccaggaaccacgaccttttgttatctggctggaaaaaacacatcatattccggttgatgagttctacactttaaagcgagcagaacgcggaaatctagtgaaagaacagttggctgaagagaaaaatatcccacaatatttgcgttcacactggcagaaagagacggggtttgcctttccttccggtcacacgatgtttgctgccagttgggcactgctggccgttggtttgctgtggccgcgtcggcgaacgttaaccattgctatcttgctggtctgggcaacgggagtcatgggaagccgcctgctgctcgggatgcattggccacgcgatctggtagtagctacgttgatttcgtgggcgctggtggcggtggcaacgtggcttgcgcaacgaatttgtgggccattaacaccacctgcggaagaaaatcgcgaaatagcgcaacgagaacaagaaagttaacgctggttgattttccgaatttagcccttaaatcatcaacaatgcgtgtggatgccatttcgcagacggcgcgaaaatggtactttaaagggctattgcggtaagttgaccataatttattcgctctaaccacataacgggaagtaatgtgaaatatttactcattttcttactggtgttagcgatcttcgtgatttcggtcacgttgggtgcgcagaacgatcaacaggtgacgtttaattatctgttagcgcaaggggagtaccgtatttccacattgctggcggtattgtttgctgcggggtttgctatcggttggttgatttgtggcctgttctggctgcgagttcgtgtttccctggcgcgcgctgaacgtaaaataaagcgactggaaaaccagctttcacccgcgactgacgtggctgtagtgccgcactcgtcagcggcgaaggaataactttctatgctggagttgttgtttctgcttttgcctgtagccgctgcctatggctggtatatgggccgcagaagtgcgcaacaaaacaagcaagatgaagccaaccgcttgtcgcgtgattacgtagcgggggttaacttcctgcttagtaatcaacaggataaagcggtagacctgtttctcgatatgcttaaagaggatacaggcaccgttgaagcccaccttacgctcggaaacctgttccgttcgcgtggcgaagttgatcgcgctattcgcatccatcagaccctaatggaaagcgcctcgctgacctatgaacagcgtctgttggcgattcaacaactggggcgtgattacatggccgccgggttatatgaccgcgcggaagacatgttcaatcagctgaccgatgaaactgacttccgcattggcgcgctgcaacagttgctacaaatctaccaggctaccagtgagtggcagaaagcaattgatgttgccgaacgcctggtgaagctgggtaaagataaacagcgcgtcgaaattgcccatttctactgtgagttagccctgcagcatatggccagcgacgatctcgatcgtgccatgaccttgctaaaaaaaggggcggcggcagataaaaacagcgcccgcgtatccataatgatgggacgcgtgtttatggcgaaaggagaatacgccaaagccgtcgaaagtctgcaacgcgtgatatcccaggacagagaactggtcagcgaaacgctggaaatgttgcaaacctgctatcagcagttgggtaaaactgccgaatgggcagaattcctgcagcgtgcggtggaagagaacaccggtgccgatgctgaattgatgcttgctgatatcatcgaagcgcgcgacggtagtgaggccgcacaggtctatattacgcgccagcttcagcgtcatccgaccatgcgtgtgttccataagttaatggattaccacttaaatgaagcggaagaagggcgtgccaaagagagcctgatggtgctgcgtgacatggttggcgagaaggtacgtagtaagcctcgttatcgttgccagaaatgtggttttaccgcatacaccctctactggcattgtccgtcttgtcgggcctggtcaaccattaaaccgattcgcggtcttgatggcctgtaatttttaaaaaaaatccgactttagttacaacatactaattattaatgttccattgtgctccggcaacgacggcgcagaaaaagcctgccaggggagaaatcgcaactgttaattttttatttccacgggtagaatgctcgccgtttacctgtttcgcgccacttccggtgcccatcatcaagaaggtctggtcatgacgttaactgcttcatcttcttcccgcgctgttacgaattctcctgtggttgttgcccttgattatcataatcgtgatgacgcgctggcctttgtcgacaagatcgacccacgcgattgtcgtctgaaggtcggcaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctctggtggggcgcgtatgatgaccgcagcgcgtgaggcactggttccgtttggcaaagatgcaccgcttttgattgctgtgacagtgttgaccagcatggaagccagcgacctggtcgatcttggcatgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgaagctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatgatgagtgattccaacagccgtctggtctactcaacggaaaccggacgtattgatgagcccaaagcggcccctgtacgccctaaaggcgacggtgtggtgcgtattcagcgtcagaccagtggacgtaaaggtaagggcgtttgcctgattaccggtgtcgatctcgatgatgccgaactgacaaaacttgcagcggaactgaagaaaaaatgcggctgcggcggagcagttaaagatggagttattgaaatccagggcgataagcgtgatttattaaaatcactacttgaagcgaaagggatgaaggtaaaactcgcaggcggttaacataaaaagccacggatatatccgtggctttcgaatattttactgtgcgtattattcagttatttcgtactgaacagaatcaagcgtattataattgcgagtcgataatcgacatttatttacgattatttaccgacctggtgaccaataacacctccgacagctgcaccacctaatgtacccaacgtactgccatcggtcagtactgcaccgcctaatgcccctgcacccgcgccgattgcggtgttgcggtcccgtttagaccagttagaacaggcactcagagacattgccaaagtaattgccagaacagccgcggtcatttttttgctcgttacaaacataatactctctcctgaatttatgattcacggaagtaagctctctataactataatagctaagaataagtctggtgaaattattccgtgaaatctgctcgcgcgcagggttatatcacgcaggtgataatgacttcctgttatatcgctgataataattttatatcttgagagtgttaataacaggtaaatagtcttaattatcaaccaggaatcatcttagagcggatgatttgccaaactgcaaatcatccgtagagaagggaaatggttaaatgtcaacgacgtgaatggtgagtttactgtgctcaagatgcatcagatcgctggcgcgtattttcgaatcggtaatcacgcgattgaatcgctcaacgggaccgatggagtatgaatgtacagcaccaaatttcgagctgtcagtcaggactatcgcttcgcactctttttccagcacggcattgaccacatcggtacgcatcatatcgcgaccggtaaatccagtttcaggttgccagccatcaataccaataaatgctttgctgaaatgcacctgttggatgcactggcgtgtcaaagggccaaccatactttcgctttttttctgatacacgccaccgagcaaaataacttcacaaggcgcgtctttcagcaaatgcgcgatgtagctgctgaccgtgatgatagtgacatttttcttctgctcgcccagagtccgggcgagtagggcattgctgctgccattttcgataaagatggtttcgcccggttgaaccagcgacgcggcaaactcggcgagttcacgcttcagcgtatagttgctcatcatacgggtttcgacgtcatcactatcaagcgaaacagcaaagccatgtgcacggcggaggtaactcagtttttcgagtgtgttgagatcctggcgaatggtaacttcagaaactccagtggcttttgccagatcggttacgctaacctgaccctggtcaatgaccatctgtagaatagtttgttgtcgggaattcatcgctgtaattcttataacgttataatacttaataaaaaaatactgacgcgccgggcatcctcaaataggaaaacctgaaggcacgattgttaaatctcccacggtgccttcgggatgtctggcgtagattcagcaacctggcgcaagagttctgctttaagtatctcgagattatggatcgcagagtggtaatcgcctgccacaaggatatctaacacaatatcaatacgttcggcaacgcgctgggcatcaaattcagacatcaaggacatccttatagcaaaagggggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgacggcgggcatcggtttggcaaacaaaaatccttgccgctcattgatcccgttcttggttaaaaaagcatcttcctttgcactctctacaccttcggcgatcacctgaagattcaatgcctgggccacagcgacgatcgcccggaccagtgactgcgagacaggttgtttgtgaatatctcgaacaaaaacctggtcaagtttgatggcatcgatcggaaagcgcgccagttgcgaaagtgaagagtagccggtaccaaaatcatccagatgcacttgcgcacctagttggctaaattgttgaataacagacagtgccagttcatcattctcaatcagacaactctctgtcagttcaacatctatagggcagtattcaaaattgagttcctggagaacctgtttcagggcggtgaaaatggtttgatcggcgagctgacgtgcagaaatatttaccgccactcgcaggtttatgcctttatcccgccactttgccacctggcgtacgacatcgagaatcacccaacggcctaaaggcacaattagccctgactcttcggcgtaggaaatgaagtccaacggtggaatcaacccacgttcaggtgactgccaacgtactagtgcttccagactgcgcacttcgccacgccaggtgattttcggttgatagtgaataaccaactgatcgttttccagtgctttacgcaagttggtatccagccagagatattcaaatacccgttgattcatttctggggtaaaaacgcaaaattgtcctcgtccgccttccttcgctgtgtacattgctgtgtcggcgtgacgaataatagccgtgctgtctgaaccatgttcgggagagagtgcaatacctactgaacagctggtataaacttcaattaaaccaatgcgaaaggggagccgtaagcgggtcaaaattcgtgatgccattgcttccagcgcgctttgtgaggtgttggatgccagtaccagaaactcatccccacctggacgcgccaacacctggtcatgttcgagacagcttaaaatagccaatgacacgtcgcgtaataactggtcaccaaacaaatgcccataggcgtcgttgacctttttgaaattatccaaatcaagatacacaaccccaactttattgttatctgcatgattaatagcgtgatcgattaaatcctgcattgcgttacgattcggcagtccggtgatactgtcggtatttgccagaatacgcagtcgctcctgagcgcggcgctcttcggtaatgtcggtgccggaacagattaaaaaaatctcgtttttgccactgccgctgtggacaaatttattgcgaaacagaaacagccgctggcctttacatgttggtatccacagttcgacttcatatgcattgccgcttcgaaaaaatacacggttattgcgcctggatgccgcagcttcacgacggctcataaacagtttaaacacgctttgcccaatgacgtcgtgttctttcaaccctgtgtaatcttcacataaccgattgaagcgttggatattcccccggctgtcgagaatcactattgcggaatgtgcttcagaaactacctgctcagcaaaggaaagcccgtgtgataaatcacgagcaaccgccggtgtgtcatgccatgcagacgcgttgccagcccattcccgtttattgatttttcgtcctaccagatgcacagaaagatcgctttcatcgacggtcagactcatcatcaggctggaggtgatgaccgtcatttccctgatgcgagcagcctgttcggcagataactgcaatgtacgatcaggttctgtggtttcggtggtagaaaagcgcaaaacatcgctgctttccgtcaaccgccagtatggattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgttttttttatatatttatttgtaatccagttttggaaaaacgccagttttcaaacgaaagtcagttaaaaaatctgcctggatataacgaaggtagagcggggaaataaacggcccatccatgaggaatgggccgtgaaaggagattacgcgaccgggcgcgcaataatgctgcgggtttccatgcggacttcggcaatagtgacgtcaataacgtcagtcactttgtaaaccgtttcacctttaatttgtacagtgccgttttcctggctgcaaaccagttcatcgcgcacagcgtgtaagaaaggtgccggaataaaggcgatagcgccgttatcaaccaaacgaacacgcatgccgccacggctgatatcgacaatttccgctgcgaaacgggtgtcggtcccggctttgtctttcaggaagcgtgcgtataaccagtcaccaacatcacgttctgccatccggttgagacggcgacgctcggccatttggacagtgatttcatcctgtgggcgcgtcgcagtttcgcctttgataaccgctttcagcagacggtggttgatcatgtcgccatatttacggatcggcgaagtccaggtggcgtatgcttccagaccgaggccaaagtgaggaccgggttcagtgctaatttcagcaaatgactggaagcgacgaatgcggctgtcgaggaaaccagttggttgcgcgtccagttcacgacgcagtttgcagaaaccgtccagcgtgagcacttcttcggcatcgacatgcagaccgtgcgttttcagcaacgctgccagcgcgtcggcattcgccggatcaaagcccatatgcacgttatagatgccaaaaccgagcttatcgcgcagtacgcgggccgcacaaatgttagcggcaatcatcgcttcttcgacgatacggttggcaatgcgacgaggctcggcgacgatatccagcacttcacctttttcaccgagaataaagcggtaatccgggcgatctttaaacaccagtgcgtggttatgacgccactcgccgcggcgttggcaaatttgcgctagcaaacggacttgttcggcaattgcttcactttcaggctgccagtcaccggtattttccagccagtcagaaacctggtcatacaccagctttgctttggattcgatggtggcggcaaagaattcgatattatcttcaatggtgccatcagcggagagcgtcatgcggcatgccagtaccgggcggacttcattggcgcgcagtgagcagagatcgtcagaaagctcgcgaggcagcatagggatgttgaagccaggcagatagttggtgaatgcgcgaattttcgcggctttgtccagcttgctgccttcagcaatccacgcggttggatcggcaatcgccacaatcagctgaagtttgtcatccggcaacgccttagcgaaaagggcgtcatccatatcttctgtgctggcactgtcgatggtgacaaaatccagcgcggtcagatcttcacgaaccagaccttcatcgagcatttcggtagcgacgccgtctggtgcttctttttccagattatggcgtgcaagggtaacccaccacggtacaaagtgatcgtcaccaaaagtgatgtattgtgtcagttctgcatagaaagaacgatcgcctttcagcggatgacggcgcatttcggcaaccgcccagtcgccttctttaaactcgtggttcaggccacgggctgcgcggcaaggaatggcgtcttttaagagtggatgatcaggaacgatggccagacggtcatttttgccctgaaccttacccacgaaacgagtcaggaacggttcaaccagttcttctggctctgcggattcacgttctttttcactgtggatcaccgcgataattcggtcgccatgcatgacttttttcatctgcggcggcggaatgaaataacttttttgcgcgtcgacttccaggaagccaaagcctttttctgtggcttttaccaccccttcagcgcgtggcgtctgggaatgcagttgctgtttaagctgcgctagcagcgggttgtcctgaaacataattgtctattttggtggccattagagcggctgacagttttacgcgaatctgtctgacgcggcaaggttaatatgtctcacccaacgcgatttttaagcgatttatccagccacacagcccgctccataccagcagattaataatctgcgttgatgatttttcgtgttcgagtaaagggctgaactgggcggcgctaaagcgatcgggtgctcgggtcagccattgtatcgcctgaacggtagcgcgctcaacagaatgacggtcagcccattggttaatttcattttcgcccttgcgcataagggtgctgatttttttatattcatttgatgaatccatacaggtggcaaaacaagcaggactgccatttatacgcgcgcataacaacgccgcaagctgattatccggctgtgtattgccccgtgtgctgtttaacaacttttcgagaagggaaagtgaaatagggtggagagagagtatttcggccagttggcaaagttctgcagttgaactttttgtgtgctcttcaggtagtttttccacctcatagctgcttcgccagcgtaatgattcatcagcaaacagtgacgcgtcggcgtagttttgtatctccagcccgggtaaccagcgtaccggatgcccgagataagcctgaaatgtcgcaattgtccgcgcctgaaagccaataaaaccaatgatttggctaatgatcacacagtcccaggcagtaagaccgacgtcattcagatgctggcgcgatcggttgtcgataatagaaggcgagctagccagttggcgggcatattgcgtgatttgtgccaaccgatgattactttccctggtggaatcaggcccggggagcggcgtaagtcgcgccgaatagtagttacataaccgctggacgccgcaaacctgagcaaccgtcagggccgtcgacaagcgttcataagcggtgaaggtctgtgaacgggtcacggtaagctggtcagggaacaaatccactgcaagaacacgcgcagggtccagccatgaaaggaagggggccagcgtttctttttcaaggatcacgtcgagtagaaagggatcgctgacctttgcggcttccgggaccagaggcagaacgtcatactccgtagtactggattgcgtttcatgataccagtggcttttgccggtgatgtggcgttgttccatgggcgctccttggtcgtaaaggaaatcgttatcctgacgcaaggcgggaaggggagaaagacggatcggcgataacaaatatcagaaaggtataacagagataacgggcggcagaacgccgcccatctttaccaacagaacgattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacaccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcaccgtctccatgttttcaccacaacagctattcggctcggtctgccccctcgctctttcagggagagggtgaccggcggttcagttcctgcagaatattctccagcaccgtctcctcattacaatcaatctcgttattccagaaacgcagcacggtccagccctgcgactcaagccagctagtgcgcctggaatcataggcaactgctaaatcatgctgcccaccatccagctcaacgactacacgcgccgagcagcaagcaaaatcgagaatgtagctccccactggatgttgacggcgaaatttgaaatcactaaaacgtcggctgcgaagatatcgccagagctttcgttcctgcaaagtgagattgcgtcttaaatcacgcgcatttgatttaattttatctatcacctcattctgacaagatttaatcttttgtcagaatgaggtgaataatctggaaggaggattcagaaaattagcgatctttacgccacgcatccgccgtcaatgcctcgccaaaatgaccggcaatcagccgtttggtgagttcatgcagcggcgatgccagcacatccgcggtgctgcctcgctcgacaacctcgccctgatgcatcaccagcacctggtcgctaatgtgcttcatcattccgatatgctgggtaacataaatatacgaaatgccctgtttttcctgtaattccagcatcagattaatcaactgcgaacgcatcgacatatccagtgaagcgagggcttcatcggcaataatgacttttgggcgcaatatcagcgcgcgcgccagacccagacgctgtttttgtccgggtgccaacatatgcggatagtaactgacgtgatccggtagcagcccaaccatacgcatcgtttcaataatctgtttgcgacgctgttccggttccaggtcggtgttcaggcgcagtggaaaatccagaatttgcgagatacgttgacggggattcaacgaggtcgaaggatcctgaaaaatcatgcgaatacgctgactgcggaaggaataatcgccaaaatgcagtggatgatcgtcaatcaataactcgccgctggtaggctctatcattcccgccagcatttttgccagcgtggatttacccgaaccattctcgccaataatcgccagtgtctggccttcacgtagcgtaaagctcaagggttttaccgcttctacggtctgacgacgaaaccagccggtccggtagcggaacgttttacttaaattacgcacttcaagcagcgtttcgatcatctcactctttctccatgttcagcgggaaatgacaggcatagagatgatttttcgcccccgtcaaacgtggcgtcacaatgcattctcgttgtgcatacgggcaacgtggccccagacgacaaccaatcggtaactgttccagcagtgggatagcgccgggcagcgtattgaggcgacttttatgcggcatcgcgctgccgaagtctggtatcgcgcggatcagcgcctgggtataaggatgatgtggcatcgtcaccaactccttactcggcgcggtttccactgtttgaccgcagtaaagcacgttaattttatccgcccattggctaagcatttgtaagtcatggctgataagcaaaatagtggtattgctgttttggttgagacgcgtcagcaggcgaaagatttgcgcctgggttgttggctccattgagttggtcggttcgtcagcaatcagcagacgcggttgattcgccagtgcaatggctatcatcactttctgacattcaccttcggtcaactcatagggaaaactgcgcatcgcatctttgtgatctttaatccccacgcggtgcagcagttcaatggcacggcgtttgcgccagccaaaacgctgccaccaacggcctttataggtccaggctgggatgttttgcatcaactggcggcccacacgttctgaagggtcaagacacgactgcggttcctggaaaatcatcgacacgttatggccaaccagtttgcgccgttcgcgtgcggagagacgcagcaaatcgatatcatcaaaacgcatacggtcagcagtaacacgccagttatctttattcaccccacaaatcgctttcgcaatcaaactcttgccggaaccggattcaccaacaagaccgcggatttcaccttcggttaaggtcatacttacccggtcgacggctttaacccactcatcaccggttttaaattcaatggtcaggttacgaatatcgagtaatggcattattccacccccgcaataatcgcacgacgaacgccatcgccaaggaggttaaccaacaacacgctaatcataattgccgcacctggcagcatgacagtccacggggcgacataaatcagttccagcgcatcaccgagcatcgctccccattcaggcgaggggagttgtgcgccgagatcgagaaagcccagcgcggcgatatcgagaattgccatcgacagtgcgcgggtgatctcggtgaccagcccggcggtgatgtttggcatcacagcaaaccagagaatattcagcgttgatgcgccatccagacgggcggcgataacgtactctttttccagttcgtcatgcaccatgctgtaaatcgaacgtaccatacgcggcagcaatgccagccagacagcaaacatagcgtgggacaaactcggtccggcaaacgctacaacgataattgccaacagcagcgaagggatcgccagtaaggtatccagaatatggttaagcaccgctgagcggaggccgtgtgtcgccccggcgaaggtgcccagtaccaggccacagatcgtcgcggcaagcgtcaccacaaatgcgccacccacggttggcgcagctccgctcagtaaacggcttaaaacatcgcgtccgaggtcgtcagtccccaggaagaaagaaacttcgccatagcgcgaccatgacggcggcaataattgataaccgagaaattgctggtcgatgccgtaaggcgcaaaccagccgccaaaaatacacagtacagccagccccgcgcagccgtacaggccgaccatcgcagaggcgtcactataaaatttgcgccaggcggtacgcagcgtgcccggcgggcgcttttcgctgtatacgctatcgtaaggcataccattccttatgtttcagagggttagccatggcacccaaaatatcagaaatcacgttaacaataatgaccagtgagccacacaccatcactccggcggaaatggctgcgtaatcctgctggcggatggcgttaattaaccagcgccctaaacccggccagctaaaaaccatttcggtgatcatcgccagcgtcagcatggtggaaaactgtaagcccaggcgaggaataaccggcggtaacgcgttatgcagaacgtggcgacgcaaaatagtaaagcgcgacaaaccgcgggtcgccgccgcttttacatagttctggtcatacacttcgatagtgctgatacgcatcaggcggatcacttcagttgttggcgcaaccgacagggtgatcacgggcaatatcatatggcggattgcgctcatgatcatttcatcccgccatggtgagtccgaaagccaggcatcaatcaacgcaaaaccggtaatcggtttcacttcgtagagcagatcgaaacgccctgaaacgggcaaccaacctagcgtgagtgaacaaaacagcgtcaacagaagcgccagccagaacaccgggattgaaaagcccagtaaggcgatggcgttgatcaagttatcctgccacttatggcgcgtaatcccggcaatcatccccacggggatgccaacaatcagcgcaaaaccgaaggcgaggatgcacagttccatcgtcgccgggaagacctcttttaactgttcggcaatcggttgaccgttaatgctggaaacaccaaaatcccagtggatcaggccgttaaaccagaacacccaggcattccacagtgacgcgccttgtaacggcgcatgaggggtgaaatagctcaagctgaagccaacgaaggtcagcaggaacaaggtgacaatcaataacaaaatgcggcgtaaggtgaagataatcatggttttttcacctcatcctgtttctcgcgatacaccccagcaaaggaggcgttaccaaacgggctaagtaccagacctttgatatcgtaccgataggcctgcaaacgcaatgacgacgccagcggcaaaatgggcaattcctgcgccagaatactctgcgcttcgtcataggcttcaatacgcgccgccagctgctgcgaagagagcgccttacgcaatacgctgtcgaatttcggatcgcaccagtgggcgaggttggtctgcgaatgaattgccgcgcagctcagtaacggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggcacccacagtttcagcgttaaattttccagccccaacgacttcaactgttcgcgcgatttcgccggattgtattcagtaattttagcctcgttgtcataggcccacgaggcgcgcggtaaaatagaggccgccgtttcagccgtaccataatagatggattgcatcaggcgctggttattaatcgccagtgccagcgcatggcggacagcgggattatttagcggcggtttggcggtgttaaatgccagataggcgacgttcatcccaggacgcagcgttaaacgcaagcgcgggtcgtcacgcaaaatggatagctggctggcagcaggccaggccagaacgtcgcattccccggtcaggagtttcgacagacgtccggtgccgccggagcctaaatccaccactacctgcggcattaacggtttaccgcgccagaagtcatcatgacgttgtaggcgaataaattgcccggcgcggtattccgacaactgatacggaccggtgccgaccggttgacggtcgagttgctcctggcgatcttctttctctaacttccgggcatattctgccgacatgaccgaagcataatgggttgcgaggtgccacaaaaaagaagcatccggctgggcgagtcggaactcaacggtatgattatccagtttgcggacgcttttcacgttatcggcaaattgcaggctgtcgaagtaggggaagttgctgccgttgacgttatgccacgggttgttgcggtcaaaaattcgctggaaggtaaacaccacatcgtcggcattcattttacgagtgggagtaaaccagtcggttttttgaaacggaacatcgcgacgcaggtggaagcgataggtcgcgccgttgtcgagtacttcccagctttcggcaagttccggcatcaggcgataggtatagggatcgacatccagcagtcgatcataaaactgggcggcaagggtatcgacaattaacccactgctcgctttggatgggttaaaggtgttgacttgcccgctgacgcaatagacaaaaccgctgtcgcggatatcagcatgcgggggagattcaggcgcggcgattgcctgaccactcacaagtccagcaatcaccaaaagagacgataatacctggcgcataatattaagggattttatgtaaagaggctatcttactaatatttaatgacatttgccattaccgtttgtgttcaggggtcgtaatgagggccgtgtggttggtcgttgaacaggtgacgtcgccatctgttcaacattcgtacccgtgatttctctataactataactcacagaacaacttagcgaggagcagagcggtacgatcgtgagaaacccattaaagcacgctgcagtgcgtgtcattgttagccagatgcggcgtgaacgctttatccggacaacgatactgaccgatcgtctgcaattaaatcattactcattaccccattgattcaaaaactctgcgatctcatcaatgcgtacgggattaatccccgcttcagcagccatttcatgttgggcttcttcgctgatctcttcattgttcatcaaacgggtgagcagtaactggaagtagtgggccagcggtgtgcgttcagcctctgcgacaggctctgcgcattcggtcgcgtactcatcggcaatatcaaaatattttagcgggatatcgtggttcattatttgcccctggggttaatgcgctaagcataagggcggatgatagcactcgtgatccgggtcatacatctttttatagttaatggcgcggcgcgttaccctcaggcaggataatgcgccgcgcatccgactattacgtttcactcaccggcgttctgtcaccatcatacaacggcactttgcgatagcggcggatcagataccataaatatgcgccgcctaacgaagcccataccagaccgagtgtcagtgacgttgactcgaggttaacccacagcacacccaccgtcagcgcgccaaccagcggcatcagcaaatagtggaagtgatccttccagcttttattcattcctttacgccgccagaaatgattaaacaccgacagattcacgaaggtaaacgccaccagagcaccgaagttaattaacgctgtggcggtaactaaatcgaagaacagcgccgacaacgcgacaatcccgaccataatgacgttgagtgccggagtccgccattttgggtgcacatagccaaacacgcgctccggaaacacattgtcacgccccatcacatacagcagacgcgacacgctggcatgtgaagccaggccagaggctaacgtgttcacaaacgtggtgcagaggaaaatcgactggaagagcttgccgccgacgtacagcgcaatttcaggcagtgcggcatccggatctttaaagcggctgatatcgggaaagaacagctgcataaagaacgacgccgcgataaagataacgccaccgtagaccgccgtcaggaagatggctttcgggatcacgcgtgcggcgtccggcgtctcttccgaaagcgtggtcaccgcatcgaaaccgaggaaggagaaacagacaatcgtcgccccggtaataatcgggatcaggtgcgcgttctcgctgataaacggctgaagtgaccagacggtgccaacgccttctcctttatgcagtccctgaactaccaggaagataaacaccaccatgatggagatttgcaccagtacaaacagggtattgaagttagcgaccaggttgacgctcttcagattcgcggcggttaaaatggcgacgaaggttaccacccacacccacggcggcacttccgggaagagggcggagagatagattttcgccaacaagacgttaatcatcggcaaaaagagataatccagcagcgatgaccagccgaccataaatccgacgtgcgggttaatcgacttttgcgcgtaggtataggccgaaccggcctccggaaactggcgaaccagtttgccgtagctgatagcggtaaacagcacacccgccagcgccagcaaataggacgccggaacgtgaccgtcgctaatgccggagacaataccaaaagtatcaaatacggtcatcggcgtgagataggccagacccatcatcaccacctgccacaatttcagtgattttcgcagacgggttttgccgggttgcgcagcaatattcagtggtgaattaatagccataattgctgcctcccctgcgtaataaggtttgcggtcgtgtcgacctgaaatcaaacctgtttagcaagggaagcaaagggggcggagtccagtcagtagcaggaggggcgcatacgcagcctccctcgccatgcggggatttaatcatcggcatcatctcatttcctcgtcacagtcttaatcgttaacggaagcccgttgccgcccgcgctccataacgcgacatccgggaaatgtctggattaccagcaaatgtcaggcctggctccgctcaggccgatgaaacaaccccgcaaggggtattacgcgtttttcaacatccactcaatttctgtttctgtgatgaggcgctcaaactgcaacagctcatcatttttacaggcgtgatagacatggcagaagcgttcgcctaaatagcggcgcaggtgatcattctcgataaactcacccagggcatcgctctggcgaatcggaaagggtaagccttcctgttccagcccgttgccttcgacttcttcctgcaacggcagctcgttatcaaggccatgcaaaataccggcaaaaatcgctgccatcaccagatatgggttggcatcggcacccgccacgcgatattccacgcggtgattatgacggtcgccgcacggaatacgcagggcgacggtgcggttgttatggccccacgacgcctgcgtcggcacatacattcccggctggaagcggcgatacgagttcacgtttggtgccagcaacgccatcgacgacggcatcaggtcaatcatcccggcgagcatctttttcagcagcggcgaatcttcgccttccgcgtcagaaagcacgttctcgccacgattattttgcatactgatatggatatgcattccgctgcccgcgtgctcttcatacggcttcgccataaaagtggcgtgcatcttatgcttttctgccatcagacgcaccaggcgttttagtgccagcgcatcatcgcaggcttccagcacgttatcagtatggtaaaggttgatttcaaactgacccggcgaggcctcagcgaccgcgccatctgccggaatcagctgtaactgcgccagttcatcaatatcattgagcacgtcggcgaagtggttgaggttatcaacggagtaaacctggctttgtgtattgcggtcatcggtgccaggcgcgcagggcggttgcagatacccttcagcgtcgcgctggcgatccagtaaatagaactccagctctaccgctacgaccgggaacaatccgcgctggcgcagctgctgccacaggcggttaagaacgttccgcggctcaacgtcaaagggagcgccatcttcatcgaccatggtcaggagcatctgaccgataaactctggatcggcggcagaaggagttaaggaaccgagaacaggaacacaggtacgatccggctcgcccatttcctgacccagacctgcttcttctactacgttgcccagaatatccattgcaaataccgaggccgggaaataacaccctttctcgagcttcttcaggcttgaaacaggaatacgctttccacggaagcaaccatttaaatcggtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcagtaatggcgataatttagtccactttgtgagattgagcatggaaaatataatgaacaatccggttatcggtgtcgtaatgtgcaggaacaggcttaagggtcatgcgacccagactctgcaagaaaagtacctgaatgccatcatccatgcaggcggcttgcctattgcgctaccacatgcgctggcggaaccgtcattacttgaacaacttttgccgaaactcgatggcatttatcttcctggtagtcccagcaatgtgcagccgcacctatatggtgaaaacggcgatgagcctgacgccgatcccgggcgtgatcttctgagcatggcgataattaatgccgcactcgaaaggcgcatccccattttcgccatctgccggggtttacaagaactggtggtggcaaccggtggttcgttgcatcgcaagctgtgcgaacagcctgaattgctggaacatcgggaagatcccgaactgccggtggaacagcaatatgcaccgtcgcatgaagttcaggttgaagaggggggattactgtctgcgttgttacctgaatgtagcaacttttgggtaaactctctacatggacaaggggcgaaggtcgttagcccacggttgcgtgttgaagctcgctcgccggatggcttagttgaggcggttagcgtcatcaatcatccttttgcgctgggcgtacagtggcacccggaatggaacagtagcgagtacgcgctttcgcgtatattgttcgagggctttatcaccgcttgtcagcaccatatcgctgaaaaacagcgactctgaccactacagtttaaggaaatgcaaatatgagtgatgagggactggcgccaggaaaacgcttgtcggaaatccgccagcagcaggggctttcacaacgtcgtgccgccgaactctccgggctgactcacagtgctatcagtacgatagaacaagataaagtcagccctgccatcagtacgctgcaaaagctgctgaaggtgtatggtctgtcactctcggaattcttttccgagccggaaaaacctgatgagccgcaggtcgtcattaatcaggacgacttaattgagatgggtagtcagggtgtgtcaatgaagctggttcataacggtaacccgaatcgcacgctggcgatgatctttgaaacgtaccagccgggcacaaccactggggaaagaattaagcatcagggtgaggaaataggcactgtactggaaggtgaaattgttctgacgattaatggtcaggattaccacctcgtcgcggggcaaagttatgccattaataccggcatcccgcacagtttcagtaatacgtcggcaggtatttgccgaattatcagcgcccatacgcccaccacgttttaatctttttgttctgtaagccgggtaagcgcaatgcgcccggcaatctatacacaaaatcattcaagttgcatcaaggcggcaagtgagcgaatcccgatgagcttactcaggtaagtgattcgggggagcgaacgcagccaaggcagaggcggcttgaaggatgaagtgtatataaagaatgtcgccagaaataaacgggcatacggcccggggatctctgcgccctgacgttcacaaactgcatatatctgatagacgtgaaacaggagtcataatgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctgaaatgaccgaacataccagcagttactacgccgccagtgcgaataaatatgcaccattcgacacgctgaatgagtcaatcacctgcgacgtttgcgtggttggcggcggctataccgggctctcctccgcgctgcatctggcggaagcgggctttgacgtagtggttctcgaagcctcacgcatcggctttggcgcaagcgggcgcaatggcggacagcttgtgaactcctacagccgcgacatcgacgtgatcgaaaaaagctacggcatggacaccgcccgtatgctcggcagcatgatgttcgaaggtggtgagatcatccgcgaacgtatcaaacgttatcagattgactgcgactaccgccccggcggcctgtttgtggcgatgaatgataaacagctcgccacacttgaagagcagaaagagaactgggaacgctacggcaataaacagctggaattgctggacgccaacgccattcgccgtgaagtagccagcgatcgctataccggtgcgctgctggatcacagcggtgggcatattcatccgctaaaccttgccattggcgaagcggacgccatccgcctcaacggcgggcgcgtgtatgaactttctgccgtgacgcagatccagcacaccacgccagccgttgtgcgaactgccaaaggtcaggtgacggcgaagtatgtgattgtcgccgggaatgcgtatctgggcgataaagtagagccggaactggcgaaacgcagcatgccgtgcggcacgcaggtgatcaccaccgaacggctgtcggaagatttagcccgttcgctgatcccgaaaaactactgtgtggaagactgtaactatctgcttgattactaccgtcttaccgccgacaaccgcctgctgtacggcggcggcgtggtctacggcgcgcgcgacccggatgacgttgagcgccttgtggtgccgaaactgctgaaaaccttcccgcagctgaagggcgtgaaaattgattaccgctggacgggcaacttcctgctgaccctgtcgcgtatgccgcagtttggtcgcctcgataccaacatctattacatgcagggctacagcggccacggcgtgacctgtactcatctagccggacgtttgattgccgaactgctgcgcggcgacgccgaacgtttcgatgccttcgccaatctgccgcattacccgttccccggcgggcgcacgctgcgtgtgccgtttaccgcgatgggcgcggcgtattacagcctgcgcgatcgtctgggcgtttaatttccgattaaccgtgaagagtcaaaaggtgtgaaacatgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaatagcccaacgcaataatgtctgatgcgctgcgcttatcaggcctgcaaacgacgtattgattatgtatgccgaataaagcattcacgccgcatccggcaagttgtattgctcaacttcgctaaatctggtgctttttcaacaacgcgcggaactgatgataagttaaccccagtaattcagccgcgcgcttctggttatatttcccttgttgcaaactgagttgcagcaactctttttcctgctgcatctgaaactcacgtaaatccagcggcagtgttggaagcgaggtggtttctgaaacggcgatagcgtcttcaggcggacgccgtttaaagggatcaataatgatgtcatcaagcggataatcgctggtgccgtggcgatacactgaacgttccaccacgtttttcaattcacgaatatttcccggccaacgataattcagcaatgtttctctggcgcgctccgtaaaccccgggaacagaggcagcttgatttcccgacacatctggatggcaaagtattctgccatcaacattatgtcgctttcgcgctcgcgcagtggtggcagttgtacaacatcaaaagccagtcggtcgagcaggtcagcgcgaaaagtgccttcattgaccatcgccgggagatcggcattcgtcgcgcataccaaccgcacattcacctgcaatggttggctgccgccaacgcgctccagttcaccgtactcaatcacgcgcaataatttctcctgcaccatcatcggtgccgtagcgagttcatcaagaaatagcgtaccgccgtcggcacgttcaaatctccctggatgacgtttttgcgcaccggtaaacgcccccgcttcgtgaccaaacagttcggaatccagcagattttcatttaacgccgcgcagttaagggaaataaacggcccttgccaacgggaggagagataatgcaggcggctggcaatcagctctttaccggtgccgcgttcgccgatgatgagcaccggtttgtccagcggtgcgagatgcgaaacctgttccagcacttcgagaaagctgttcgcctcaccaagtaaattatctttgtattctgccatgatgaaattcgccacttgttagtgtaattcgctaactcatcctggcatgttgctgttgattcttcaatcagatctttataaatcaaaaagataaaaaattggcacgcaaattgtattaacagttcagcaggacaatcctgaacgcagaaatcaagaggacaacattatgggtattttttctcgctttgccgacatcgtgaatgccaacatcaacgctctgttagagaaagcggaagatccacagaaactggttcgtctgatgatccaggagatggaagatacactggttgaagtacgttctacttcggcgcgcgcgttggcagaaaagaaacagctgactcgccgtattgaacaagcgtcggcgcgtgaggttgaatggcaggaaaaagccgaactggcgctgctgaaagagagagaggatctggcacgtgcagcgttaattgaaaaacagaaactgaccgatctgattaagtccctggaacatgaagtgacgctggtggacgatacgctggcacgcatgaagaaagagattggcgagctggaaaacaaattgagcgaaacacgcgctcgccagcaggcattgatgttacgtcatcaggcggcaaactcgtcgcgcgatgtgcgtcgtcagctggacagtggcaaactggatgaagcaatggctcgtttcgaatctttcgaacgtcgtattgaccagatggaagcggaagcagaaagccacagcttcggtaaacaaaaatcgctggacgatcagtttgccgaactgaaagccgatgatgcaatcagcgaacaactggcacaattaaaagccaaaatgaagcaagacaatcaataataacatccaggcggcgtccgaacgcgccgccgctcatcgtctaaggagtacttatgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatctattcttgatgcagaacatccgaactggagggatcgctaatggcgggcattaatctcaataaaaaattatggcgtattccacagcagggcatggtccgcggcgtctgcgccgggattgccaactattttgatgtaccggtaaaactggtgcgtatcctggtggtgctgtcgattttcttcggtctggcgctgtttaccctggttgcttacatcattttgtcatttgcgcttgatccaatgccggacaacatggcctttggtgagcagctaccttccagcagcgaattgctggatgaagtcgaccgtgaactggcggcaagtgaaacgcgtttacgcgagatggaacgttatgtcacttccgatactttcacgttacgtagccgtttccgtcaactgtgaggaaagttatgaatactcgctggcaacaggccgggcaaaaggtaaagcctggtttcaaattagcaggcaagctggtacttcttaccgcactgcgctatggcccggcgggtgtggcgggctgggcgataaaatcagttgctcgccgaccgctgaaaatgttgctggctgtggcgctggaaccgctgttaagtcgggctgctaataaactggcacagcgttataaaaggtgaggggagtttcgcaaaaattgttaaatctcaggcgtataatggatggcaattttcatccatagaaggacgcttacatgtttaaaaaaggcttacttgctctggcactggtgttttcactgcccgttttcgccgctgaacactggatcgatgttcgtgttccagagcagtatcagcaagagcacgttcagggggccatcaatattcccctgaaggaagtgaaagagcgcattgccaccgccgttccggataaaaacgacaccgtgaaagtgtattgcaatgccggacgccagtcagggcaagcaaaagagatccttagcgagatgggatatacccacgttgagaacgccggtggcctgaaagacatcgcaatgccgaaggtcaaaggttaaaagaattcaccatgagcggcgcttatgcgccgtttttttttctgtcacaccttatttacatccccatagattatttgcgtcagctcacaaatacgctttttccctggtaaaaaatgatttcctgcgtgactaaaacccttgtgctcaattgacagtttattttctgcggagtagtctctcgtttcatgggaccgctaccacggaaaggcaacatgaaacagaaaattacggattacctggacgaaatctacggtggaacatttaccgcaactcatttacagaaacttgtaacgcgtcttgagagtgcgaaacgattaattacacagcgacgtaaaaaacactgggatgaaagtgatgtcgtgttaattacctatgccgatcaatttcacagcaatgatttaaaaccattacccacatttaatcagttttaccatcaatggctgcaaagcattttttcacatgttcatttgttgccgttttatccatggtcatctgatgatggcttttcggtaattgattatcatcaggtcgccagtgaagcgggggagtggcaggatattcagcaactcggtgaatgcagtcatttaatgtttgattttgtctgcaaccatatgtcggcaaaaagtgaatggtttaaaaactatttacaacagcatccaggttttgaagatttttttattgccgttgacccgcaaaccgatctcagcgccgtcactcgcccgcgtgcgttaccgttattaacgccattccagatgcgcgatcattcaacgcgccatttatggaccacctttagtgacgatcaaattgacctgaattaccgtagccctgaagtgttgctggcgatggtggatgttttactctgttaccttgcgaaaggtgctgagtatgtccgcctggatgccgttggctttatgtggaaagagccgggaacaagctgcatccatctggaaaaaacacatctgattatcaaactgttacggtcgattattgataacgttgcgccaggtacagtgatcattaccgagaccaatgttccgcataaagacaacattgcttactttggcgcaggcgatgacgaagcacatatggtgtaccagttctcgctgccgccactggtgctgcatgcggtgcaaaaacagaacgttgaggcgctttgtgcgtgggcgcaaaacctgacactaccttccagcaacaccacctggtttaacttcctcgcctctcacgatggcatcgggctaaacccgctacggggcttgttgcctgaaagcgaaatattagagctggtcgaggcgttacagcaggaaggtgcattagtaaactggaaaaataatcccgacggtacacgcagtccgtatgaaataaatgtgacctatatggatgcgttaagccgccgtgagagtagcgatgaagaacgttgcgccaggtttatccttgcccatgcgattttgttaagtttccccggtgtgccagcgatatatattcaaagtattcttggctcgcgtaatgattacgcaggtgtcgaaaaactcggatataaccgtgcgattaaccgtaaaaaatatcacagtaaagagataacccgagaactgaacgatgaagctacattaaggcatgcggtatatcatgagttgtcgcgtttaattacacttcgtcgcagccataacgagtttcatccggataataattttaccattgatacgattaattcatccgtaatgcgtattccaagaagtaacgctgatggtaattgtctgactggattgtttaatgtcagtaaaaatattcagcatgtaaatattactaatctgcatggtcgggatctgattagtgaagttgatatattgggtaatgaaataacgctgcgcccctggcaggttatgtggattaaataaaaaggaacatctcatgattaaatcaaaaatcgtgctgttatcagcactggtttcatgcgccctgatttcaggctgtaaagaagaaaataaaacgaatgtatccatcgaatttatgcattcttcggtggagcaggagcgccaggccgttatcagtaaattgattgcccgttttgaaaaagaaaaccctggcatcaccgttaagcaagtgcccgtggaagaagatgcctataacactaaagtcattactctttcacgtagcggttcgctgccggaagtgatcgaaaccagccatgactacgccaaagtgatggacaaagagcagcttatcgatcgcaaagcggttgccacagtcatcagcaacgttggtgaaggcgcgttttacgatggcgtactgcgtattgtgcgtaccgaagatggtagcgcatggaccggtgttcctgtcagcgcctggattggcggtatctggtatcgcaaagatgtgctggcaaaagcggggcttgaggagccgaaaaactggcaacagctgctggacgttgcacagaaactgaatgacccggcgaataaaaaatacggcattgcgctgcctacagcagaaagcgtgttgacggaacaatccttctcccagtttgcgttatccaaccaggctaacgtctttaacgccgaaggcaaaatcacccttgatacaccagagatgatgcaggcactgacctattaccgcgaccttactgccaacactatgccgggttctaacgacatcatggaagtgaaagacgcctttatgaacggcaccgcgccgatggcgatttactccacctatatccttccggctgtgattaaagaaggcgacccgaaaaacgtcggtttcgtggtgccaaccgagaaaaactctgcggtctacggcatgttgacctcgctgaccattaccgccgggcaaaagaccgaagagacggaagcagcagaaaaatttgtcacctttatggagcaggcagacaacattgccgactgggtgatgatgtcgccaggtgctgcgctgccggtgaataaagcggtggtgactaccgccacctggaaagacaacgacgttattaaggcgctgggtgaactaccgaatcagctaatcggtgaactgccaaatattcaggtttttggcgcagtaggggataaaaactttacccgcatgggtgatgtgacgggttctggcgtggtgagttcaatggtgcataacgtcaccgtgggtaaagccgatctctctactacgctgcaagcgagccagaaaaaactggatgaactgatcgaacagcactaaacccaggacaggaatccgcaatgaacaggcttttttcaggtcgttccgatatgccctttgcgctgctgcttctcgcgcccagcttattactgctgggcggtctggtggcgtggccgatggtgtcgaatatcgaaatcagttttttacgtctgccgctcaatcccaacatcgagtcaacgtttgttggggtgagcaactatgtgcgtatcctctccgatcccggcttctggcattcgctgtggatgacggtctggtataccgcgctggtggtggcgggcagcaccgtgctcgggctggcggtggcgatgtttttcaaccgcgagttccgcctgcgcaaaaccgcgcgttcgctggtgatcctctcctacgtaacgccgtccatttcgctggtgttcgcctggaaatacatgttcaacaacggctacggcattgttaactacctcggcgtcgatcttctgcatctctatgagcaggcaccgctgtggttcgataatccgggcagtagctttgtgctggtggtgctgttcgccatctggcgctacttcccgtatgcctttatctcgtttctggcgattttgcagaccatcgacaaatcgctgtacgaagcggcagagatggatggcgctaatgcctggcaacggtttcgtatcgtcacgctgcccgcaattatgccggtcctggcgacggtggtgacactgcgcaccatctggatgttctacatgttcgcggatgtttatttgctgacgaccaaggtcgatattctcggtgtatatctctacaaaaccgcctttgcctttaatgatttaggaaaagcggcggcgatctcggtggtgctcttcatcattattttcgctgtcattctgctgaccaggaaacgggtgaacctcaatggcaacaaataaacgcacactcagtcgcatcggtttttactgcgggctggcgctgtttctcatcatcacgctgtttccattttttgtgatgctgatgacctcgttcaagggcgcgaaagaggcgatctcactgcatcctacgctgctgccgcagcagtggacgctggagcattacgtcgacatttttaacccgatgattttcccgtttgtcgactacttccgtaacagtctggtggtgtctgtggtttcatccgtggtggcggtattcctcggcattcttggggcttacgcgctttcccgcctgcgctttaaaggtcggatgaccatcaacgccagcttttacacggtgtatatgttctctggcattttgctggtggtgccgcttttcaaaatcatcaccgcgcttggcatttacgacactgagatggcgctgatcatcaccatggtgacgcaaactctgcccaccgccgtgtttatgctgaaaagctacttcgacaccatccccgatgagatcgaagaagcggcgatgatggatggcctcaaccgtctgcaaattatcttccgcatcaccgtgccgttggcgatgtccgggctgatatccgtgttcgtctactgctttatggtggcgtggaacgactatctgtttgcgtcgattttcctctccagcgccagcaatttcaccttaccggtgggcctgaacgcgctgttcagtacgccagattacatctggggacggatgatggcggcctcactggtgaccgcattgccggtggtgattatgtatgcgctttcggaacgttttattaagagtggtttgaccgccggtggcgtgaagggctaaagcggccagtttctttacaaggagttttaaatgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaattcaaaggaatgaaaaaaatgaaaatcggcacacagaatcaggcgttctttccggaaaacattctggagaaatttcgttatatcaaagagatgggcttcgatggttttgagattgacggcaaactgctggttaacaacatcgaagaagtcaaagcggcgatcaaagaaaccggtttaccggtgaccaccgcctgcggtggctatgacggatggattggcgactttatcgaagagcgtcgtcttaatggcttaaagcagatcgagcgcattctcgaagcgctggcagaagtgggcggtaaaggcatcgtcgttccggctgcgtggggcatgtttaccttccgcttaccgccgatgacctcgccgcgtagcctggacggcgaccgcaaaatggtgagtgattccctgcgcgtactggaacaggtcgccgcgcgtaccggaaccgtggtgtatctcgaaccgttaaaccgctatcaggatcatatgatcaacaccctcgccgatgcccgccgttacatcgtcgaaaacgatcttaaacatgtacagattatcggcgatttctatcacatgaatatcgaagaagataacctggcgcaggcgctgcatgacaaccgcgacctgctcggtcatgtgcatattgcggataaccatcgctaccagccgggcagcggcaccctggatttccacgcgctgtttgaacagctgcgcgcggataactatcagggctatgtagtgtacgaagggcgtatccgggcggaagatcctgcccaggcgtaccgtgattcgttggcctggttgcgtacctgctaagaggtctttgtgaaaagtgcaatgacaagctctccgctgcgggtcgcgataataggcgcaggccaggtggcggataaggttcatgcttcgtactactgcacccgcaacgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcactggaagcgggctgccatgtgatgtgcgaaaaaccgcccgccatgacgccagaacaggcgcgggaaatgtgcgataccgcgcgcaaactgggcaaggtgctggcctacgactttcaccatcgttttgcgctcgatacgcaacagctgcgtgaacaggtgaccaacggcgttttgggagagatttacgttaccaccgcccgcgccctgcgtcgctgcggcgttcccggctggggtgtctttaccaataaagaactgcagggtggtggcccgctgatcgacatcggcattcatatgctggatgctgcgatgtatgtgctgggctttccggcggtgaaaagcgtgaatgcgcatagctttcaaaagatcggcacgcaaaagagctgtggtcaatttggtgagtgggatccggcaacttacagcgtcgaagattcgctgtttggcaccattgaatttcataacggcggcattctgtggctggaaacgtcatttgcactcaacatccgcgaacagtcgattatgaacgtcagcttttgtggtgataaagctggtgcgacgctgtttccagcacatatctacaccgataacaacggtgaattaatgacgctgatgcaacgggaaatagcagacgacaaccgccatttgcgcagcatggaagcctttatcaatcacgtacagggcaagcccgtgatgatagccgacgccgagcaggggtacatcatccagcaactggtggcggcgttgtatcaatccgcagaaacagggacgcgtgtggaattatgaccaggccagtaacgttatcagaaccccatttcagccagcataccctgaacaagtatgcatcgctgatggcgcaggggaacggctatcttgggcttcgcgccagccatgaagaagattacacgcgccagacgcgagggatgtatctggcggggctgtatcatcgggcgggaaaaggtgaaatcaacgaactggtgaacctgcctgatgtcgtggggatggagattgccataaatggtgaggttttctcgttatcccacgaagcctggcagcgtgagcttgactttgccagtggcgaattacgccgcaatgttgtctggcgtaccagcaacggctcaggttacaccatcgccagccgtcgctttgtttcggcagaccaactgccgctcattgcgctggaaatcactattacgccactggacgccgacgcgtcagtgctgatttcaacaggcattgacgccacgcaaaccaatcacggtcgccaacatctcgacgaaacccaggtgcgggtgtttggtcagcatctgatgcaggggagctacaccacccaggatggacgcagtgatgtggccatcagctgttgctgtaaggtgagcggtgatgtgcagcaatgctataccgccaaagagcgccgtttactgcaacataccagtgcgcagcttcatgcaggcgagacaatgacgttgcaaaaactggtgtggatcgactggcgggatgacaggcaagctgctttagacgagtggggcagcgcgtcgcttcgccagcttgaaatgtgcgcgcagcagagttacgaccaacttcttgcagcatcaacagaaaactggcgtcaatggtggcagaaacgtcgtatcacggtaaatggcggcgaagcgcacgatcagcaagcgttagattatgcgctttatcatctgcgcatcatgacgcctgcccacgacgagcgcagcagcattgcggcaaaaggcttaaccggcgaaggctacaaaggccacgttttctgggatacagaagtatttttgttaccgtttcatctgtttagcgatccgacggttgcccgaagtttactgcgttatcgctggcacaacttgccaggcgcgcaggagaaagcgcgacgcaacggctggcagggcgcgctatttccgtgggaaagcgcgcgcagcggcgaagaagagacgccggaatttgccgccattaacattcgcaccgggctgcggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccagaaattcagcccgacggcgttttgccgcaggatgattcgtttatggctaagccggcgattaatctggcgaaatacaaagcggcggcggggaagcaaaccatactgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccgcatagttgtgatgatggtatccatgctgccgcaactggcgctatctggctgggggcgattcagggttttgccggggtgagcgtgcgtgacggtgaattgcatctcaatccggcgttacctgagcagtggcaacagttgtctttccctctgttctggcagggctgcgaattacaggtcactcttgacgcgcagcgtattgcgattcgaacttctgcgcccgtttcactgcgtttgaacggtcagcttataaccgtggctgaagaatctgttttctgtttgggtgattttattttgcccttcaatgggaccgctaccaaacatcaggaggatgaatgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatagcaaaggaatcaacatggctcagctttcgttacaacatattcaaaaaatctacgataaccaggtgcatgtggtgaaggacttcaacctggaaattgccgataaagagttcatcgtgtttgtcggcccgtcgggctgcggtaagtcgaccaccctgcgcatgattgccgggcttgaggagatcagcggcggcgatctgttgatcgacggcaaacgaatgaatgacgttccagccaaagcacgcaatatagcgatggtgttccagaactacgcgttgtatccgcatatgacggtttacgacaacatggcgtttggtctgaagatgcaaaaaatcgccaaagaggtgattgatgagcgggtgaactgggcggcgcaaattctcggcctgcgtgagtacctgaaacgtaagccgggggcgctttccggcgggcaacgtcagcgagtggcgcttgggcgggcgattgtacgcgaagcgggcgtgtttttaatggatgaaccgctctctaaccttgatgccaagctgcgcgtgcaaatgcgcgcagagatcagcaagctgcatcagaaactgaacaccaccatgatctacgtgacccacgatcagaccgaagcgatgaccatggcgacgcggattgtgattatgaaagacgggattgttcagcaagtaggtgcgccgaaaaccgtttataaccaacccgcgaatatgtttgtttccggatttattggatcaccagcgatgaattttattcgcggcacgatcgatggcgataaattcgttacggaaacgcttaaattaaccattcccgaagagaaattagcggttctgaaaacacaggaaagtttgcataagcccatcgtgatgggaatacgaccggaagatattcatccggacgcgcaagaggaaaataacatttccgccaaaattagcgtggcagaattaaccggtgcggaatttatgctctacaccacggttgggggcacgagttagtggtccgtgctggtgcgttaaatgattatcatgcaggagaaaatatcactattcattttgatatgacgaaatgtcatttctttgatgcagaaacggaaatagcaattcgctaaatacagggggaaggcattcccccaggataatacaaggaacaataatgaaaaagttattaccctgtaccgcactggtgatgtgtgcgggaatggcctgcgcacaggccgaggaaaggaacgactggcactttaatatcggcgcgatgtacgaaatagaaaacgtcgagggttatggcgaagatatggatgggctggcggagccttcagtctattttaatgccgccaacgggccgtggagaattgctctggcctattatcaggaagggccggtagattatagcgcgggtaaacgtggaacgtggtttgatcgcccggagctggaggtgcattatcagttcctcgaaaacgatgatttcagtttcggcctgaccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactaccggttacgctgatacccgtgtcgaaacggaaacaggtctgcaatataccttcaacgaaacggttgccttgcgagtgaactattatctcgagcgcggcttcaatatggacgacagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtaggtttattttacggttatgatttccagaacggactttccgtttcgctggaatacgcgtttgagtggcaggatcacgacgaaggcgacagtgataaattccattatgcaggtgtcggcgtaaattactcgttctgataatgggctaaattgccggatgcggcgcgagtactttatccgatctataaatgtaggccggataagatgcgctagcatcgcatctggcattcaggcaaggtagctggtatttatttcagcgtcatatgcgtggcaacggtaatattctgtggtgacggttttccagaaattaagcggaataataactcgcagctttgttgacctaactcctgcgtcggaacatcgatgccgcccggtgcaggcgttaaaataaatgacagcgtttcattgctataacccaccaccgctaactgctgcggaatagcaatatttttctctgctgccgcacgataaatgctcattaatttcaggctgtcagtggcaaacaccgcctcaggcaacggtgactggcttaataattgccgtgctgcttttaatgcagtttcatgggtataaccgccatcaacaatccattcatcacgcactgcaatattatgcgcagccaggctctgcttataaccattaacgcgatcaaccgaaacatggacatcaagcggagcatgcaggcaggcaatattttgatgcccactttcaattaatgcatcggtcaacgcaatgctgtcgccaaaattatcggtatcgacagaataaacatgggcatattgaccttcaactttgccaatcaccaccaccggaatatcatatttatcgagttgggcaaaaaatgactcatccgctggcgaactgagcataataatgcctttaatcattttctgcttaattttgctttcgcatttttgcagatcttctgccggattgtgcgacgtttgtaatatcacgtcgaaaccttcttcttcagctttggcggtgatggcatgcaaaacttcagagaaaaacggattacccgccgtagttttggtcgaacgggtagaaatcaccataatggcatcaaaacccgaagaggtcagcgcgcgggccagcttgtttggctgatactgtaattcttcaatggcccgtaacactttttcgcgcgcttccggggagatattagtttgcttattcagcacgcgtgatacggtggattttgatacgcctgcaaccctggcaatatcataaatagtaggggacataggtcaggaactccgtccgaacgtgaatgctgcacatcttatggagttcgccggtcgatgacaacacgggcagttgataatcaatggcctggcccccacattcatatccttacgaatgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgcttaatattcacgccggagcacgtttgccgctgttaagtgcggtgcgtgaagagcgcctgctgggcgtgaaacgcattccccagcgtgactttggcattccgcgcttcacctatgacgaagggctggcgcagttatatggcgatccacccgcctggccaacgccaacgcgcggcgtcagtgaaatccgcctggcgctacgttttaaatcgaatgattcgctgctacgccactttaaggatacctccacgctgtatctggaaattgtggattatcccggcgaatggttgctcgacctgccgatgctggcgcaggactatttaagctggtcgcgccagatgacgggcttactcaatggtcagcgcggagaatggtcggcgaaatggcgaatgatgagcgaagggctggacccgctagcgcctgccgacgaaaaccggctggcggacattgccgccgcgtggaccgattatctccaccactgtaaagagcaggggctgcactttattcagcctgggcgctttgtcttgccgggagatatggcaggtgcgcccgcgctgcaattcttcccgtggccggatgtcgatacctggggcgagtccaaactggcgcaggccgataagcataccaatgccggaatgctgcgcgagcgctttaattattactgcgagaaggtggtgaaggggttctataagaatcattttctgcgctttgaccgccagattgtgctggtggattgcctgcaacctctcaacagtgggccacaggcatttaatgatatgcgtctggcactgacgcagctgatgcaaagttttcactacgggcagcgtaccctgttccggcgtttgttttcgccggttatcgataagctattgtttgctgccactaaagcggaccatgtgaccatcgatcagcacgctaatatggtttcattactgcaacaactgattcaggatgcctggcaaaatgcggcgttcgaagggatcagcatggactgcctggggctggcgtcagttcaggcgaccaccagcggcattattgatgttaacggtgagaaaatcccggcgctgcgtggtaatcgacttagcgatggcgcaccgctcactgtttatcctggcgaagttcccgcacgtttgcctggtcaggcgttctgggataagcaaggcttccagtttgaggcatttcgtccgcaggtgatggatgtcgacaaaccactaccgcatattcgtcttgatgctgcgctggaatttttaataggagataaattgcgatgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggagggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataatgcaatatcgggtgctgaccggatatctttacgccgaagtgcccgtttttccgtctttgtgtcaatgattgttgacagaaaccttcctgctatccaaatagtgtcatatcatcatattaattgttcttttttcaggtgaaggttcccatgcgtctggaagtcttttgtgaagaccgactcggtctgacccgcgaattactcgatctactcgtgctaagaggcattgatttacgcggtattgagattgatcccattgggcgaatctacctcaattttgctgaactggagtttgagagtttcagcagtctgatggccgaaatacgccgtattgcgggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcacaattgattaacggctttaattttttacgttggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgttgcgatcaacgattcgtatgggccgccagttgcaaaatgtcgccgcccaggacgtcagcgccttcagtcaaattgtcgccgtcagcccgaaaatgaagcatgttgtcgaacaggcgcagaaactggcgatgctaagcgcgccgctgctgattacgggtgacacaggtacaggtaaagatctctttgcctacgcctgccatcaggcaagccccagagcgggcaaaccttacctggcgctgaactgtgcgtctataccggaagatgcggtcgagagtgaactgtttggtcatgctccggaagggaagaaaggattctttgagcaggcgaacggtggttcggtgctgttggatgaaataggggaaatgtcaccacggatgcaggcgaaattactgcgtttccttaatgatggcactttccgtcgggttggcgaagaccatgaggtgcatgtcgatgtgcgggtgatttgcgctacgcagaagaatctggtcgaactggtgcaaaaaggcatgttccgtgaagatctctattatcgtctgaacgtgttgacgctcaatctgccgccgctacgtgactgtccgcaggacatcatgccgttaactgagctgttcgtcgcccgctttgccgacgagcagggcgtgccgcgtccgaaactggccgctgacctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaagcgcgaatatgcctgatggtgcaacaccatcaggcatattaaattatgctttcagtacagccagagctgcttcgtaatccggctcggtggtgatttcatccaccagctggctgaaaatcacattgtcattttcgtcaataaccacaacggcacgcgctgccagacctttcagtgggccatcagcaattgccacaccgtaagcttgcagaaattcagcgttacggaaagtggagagggtgataacgttgttcagaccttctgcgccgcagaaacgagactgggcgaacggcagatcggcagagatacacagcacaacggtgttgtcgatctcagttgccagttggttaaacttacgtactgatgcggcgcaaacaccggtatcaatactcgggaaaatgttcagcactttgcgtttacccgcaaactgaccgagggtgacgtcagacagatcttttgccacgagagtaaaagtctgcgctttgctacccgcctgcgggatggaattggcgactgtaaccgggttgccctggaaatgaacggtttgtgacatgattatctttcctgtttacatatagttaacgtcacacctagtttatgctaactgtcaataacacagcaaacgctatttgcgcttaatccgcagaccaccgcgacaacaaggagtaaagatgagaaccgttaaggtattcgaggaagcctggcccttacataccccgtttgtgattgcccggggaagtcgcagtgaagcgcgcgtggtggtggttgaactggaagaagagggtattaaaggcaccggcgaatgcacgccgtatccgcgttatggggaaagtgatgcctcggtaatggcgcaaattatgagcgtcgtgccgcaactagagaaagggctgacacgggaggagttgcaaaaaattctccctgccggcgcagcacgtaatgcgctggattgtgcattgtgggatctggccgcgcgaagacagcagcaatcgctggctgatttgatcggcataacgcttcccgagacagttatcactgcacagacggttgtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttgccgatttgtgctgatgaaagttgtcatactcgtagcaatttgaaggcgctgaaagggcgctatgagatggttaatattaagctcgataaaaccgggggtctgacggaagcgctggcgctggcgactgaagcgcgtgcacaaggtttcagtctgatgctgggctgcatgttgtgtacctctcgtgccattagcgccgctttaccgctggtgccgcaggtcagtttcgccgatcttgacggaccgacctggctggcggtagatgtggaaccggcgcttcagttcacgacgggcgaattgcatctttaggatgccagcgcagcaagtttgccatcgcaaagagatatttttcgctggcttcgtcggaggagatgggcggaaactctgcggtgatgcaatgcaagttcagatctgcacaccaactgccgaaagagccaggcgtttcataaccgacgctggttaccagaggcaattcaaacgcctgagccagccattcgcctaattcgctgtgtctgggatcttcaatacaggccagtggatcgtggaatgagaccacccaggcaggttgaatgcggtgtataagctggcacagcgcctgggtttcaggttcggagccaggtttgtcacctgtcagtaatacgacatcgcgttcttcagcggcgctgttccagcgataaacggtttcaccttccttccagttcgccgccggaaagtttctgtttaaatccacaccattagcattggcccgtaaccccaactggcagccgtcaggattcacacacagcaccacatgatgacggcgcaaagaaggtgtcaacgtccgcagagcacaggagagcgtgacgaccgaagagttttcatcaccgtgagtgccagccagaatcaaaccactttcgcggctggctgcaggggcaggaaaccagattaacggcgcgcccaataatgaacgtccgtaatgttctgttccgggcggaaatgcgccgcgttcggcgcgtgggcgggttacggtcatgatcgtctctggttcaggaagtattacaggcagtgttgtgcaaattttgcggattatcaaatccttttcttcaacgctatgtcatcgatcttgtatcacttttttgccggaagttgtttgcattttattagttggatagggtttgtggatttttgctggctgacgggcaaataaagtttgtttaatggtttgcttatctgccagttgattaatcacatggcgggctatctgaccgccagcaccaagaatcagtacatttttcatgaaaattatcccagattattggcagcaatatgccagtccatatcactattgcggatttgaatatgtttcattacagagtttcctcaaagaacggagctaatactgaaattgcttcagccacataggctttgccgtcataaagatccatatggtttgcgccttcaacaatgtgatagcgtttatcctggcttgatgctcgatcgtacaggtcgtcactcatccatttgctccctgcctggctgcccgccacaatctgcgtcggctgagtcaggtacacttccgccatatggtaagcatcataggtaataatctggttaaggctgcgcaaagtagcgtaacccggtgctgttggatactgcgcgcgaggggtgtggtaatactcccaggcctgacgcagttcttcgttcggcgcatcggactccttcattggtgccagtggcataatggcgtattctccgctgctaatatcgctggttctggcgtttgaacccgcttcaacgtatggcagggcatcaatagatttcacattgttttcccaaccattacggaatatcgaaccaatattgaccgcactaacggtaccgatggccttgatgcggcgatcctgaattgcagcattggctgtatatcctgcaccggcacaaattcccatcgcaccaattcgggtattgtcgacataagaaagcgttgtcaggtaatcaatcacggcactgatgtcttcagtacgaatgtatgggttttctaactgacgcggctcgccgccactttcaccttgataagatgcgtcataagcaatagtgacaaatcccttttccgccagttttttggcataggttccggccgtttgttctttaacgcccccacctgggtgagataacacaattgcctgatactgacgggtttcatcaaattttggagggaaatagatcactgcagacaaagagatggttggattattgctgttagtgaagctgactttattattcatcattccgttcctcatggagttgtcggttcgttttaacggttggtgatatcactatagatattgatcattaagttgattagacccaaaatcatgattagacctatcatttaaatgattaatagattgcatggagatactgaatgaagcgtgaagaaatcgctgatctgatggcgtttgtcgtcgttgcagaggagcgtagcttcactcgtgcagcagcccgcctgagcatggcgcagtcagctttaagccagatagtgcgtcgtatagaagaacgattgggattgcggcttctgacgcgaaccacgcgcagcgttgttccaactgaagcgggcgagcatcttttgtctgttcttggccctatgttgcatgacatagattcagccatggcatccctgagcgatctgcagaaccgcccatccgggacaatacgtattactactgtagaacatgcagcaaaaacgatattgttaccagcaatgcgcacattcctgaaatcgcatcctgaaattgatattcagctcaccattgattatggtttgaccgatgtcgtttctgaacgttttgatgcaggcgtccgtctgggtggggagatggataaagatatgatcgccattcgaatcgggccagatataccaatggctattgttggctcaccggattatttttctcgccgaagtgttccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaagaaaaaaaactgatacgtgttttggataaattcacaccagatttacccggttatcacctgtactatccacaccgtcgacatgctggctcggcattctcattatttatagataggctgaagtataaaggtgctgtttagcactacttgctgatacattaatttaattcttctcttaacgtattctcagttcctttcaacgttttggtcattttttattcttcgtacaatggcgacagatgctgattatgataccgaaaacgggtttgaacgtgcgaagcccgaacgtagtgttcggagttctatgtgctttaccgcattttggagactattatttacactaaatctgatttgatatattgatacttaaaacatttgatgcttcctttgtcacttttttgatggaagttgtttgcatttctttaaggcgaaacaaataattacgcatcaattttaatgtcggttagagggaaacttatgaagcactctgtttcagtcacgtgttgtgcgctgttggtcagcagcatttctctttcgtatgctgcagaagttccgagcggcacagtactggcagagaagcaggagctggtgcgccacattaaagatgagcctgcgtcgctggatcccgctaaagccgtgggcctgccagagattcaggtcattcgcgatctgtttgaaggtctggtgaatcagaacgaaaaaggggagattgtccccggcgttgcgactcagtggaaaagtaatgacaaccgtatctggacttttaccctgcgcgataacgcaaaatgggcggatggcacaccggtaacggcgcaagattttgtctacagctggcaacgtctggtggacccaaaaacattgtcgccatttgcatggtttgccgcgctggcgggaatcaacaacgcacaggcgattattgatggtaaagctacgcctgaccagcttggcgtcaccgcagttgatgcccatactttgaaaattcagcttgataaaccgttgccgtggtttgtgaatttaaccgctaactttgccttcttcccggtgcaaaaagccaacgtagaaagcggtaaagagtggacgaaacccggaaatctgatcggcaatggcgcttatgttcttaaagagcgcgtagtcaatgaaaaactggtcgtggtaccgaatacccattattgggataacgccaaaacggtactgcaaaaagtgaccttcctgccaattaatcaggaatccgcagccactaagcgttacctcgcgggggatattgatatcaccgaatccttcccgaaaaatatgtatcagaagctgttgaaggatattccggggcaggtttatacgccgccgcagctcgggacctattattatgcgtttaacacgcaaaaagggccgacggcagatcagcgcgttcgtctggcattaagtatgacgatagatcgccgcctgatgaccgaaaaagtattagggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagctgacgcttttgtataacacttcagaaaaccatcaaaaaattgcgattgctgtagcatcgatgtggaaaaagaaccttggcgtagatgttaaattgcaaaatcaggaatggaaaacctatatcgatagccgtaacaccggcaattttgatgttatccgcgcctcgtgggtgggggattataatgaaccctccactttcctgacattattaacgtcaacgcattcaggaaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataatcctgaagatgtggcgtacagtcggactatgtatattgtgaagcattgatgtgatgggaactggcgttacccttgtgcataacgccagtgatgtctgatttagcgaccctgttccggcggtgtaatgttatccatatacagcgtctggctggggaaggcaaagtccgcgccgtgtgactgtacaatatcgataatcttcaaataaacgtcttgctgtgcagcaagccattcagcccataccgtggttttggtaaagcaataaaccataatattcaatgaagagtcagcaaactggttgaaataaaccagtaaggtttgtcgctggtcgatggccgggtgatttttcagcatctcacgtacagcttcgacaataacgcccacttttgccgcatcctcataacgtaaaccaatggtcgtggtaatgcggcggttggtcattcgtcctgggttttctacgctgatcgacgaaaacagcgagttcggtacgtacaatggacgattatcaaaggtcgtaattttggtaattcgccagccaatttccgctactgtaccttcgatatttctgtccggtgaacggatccagtcgccaatactgaaaggacggtcgaaatagagcataatcccggaaaagaagttactcagaatatctttaccggccataccgacagccagaccaccaataccaccaaaggtcagcaagccagaaaggctcatgccgaaatgttcgccataaagcagaacaagcaccacaataatggtgattttgatgatacgcgacataatccgcgcactggtgatatcgcgaccttttttaatctgctgtttttcaaactgattaatcagcagaaatagcttaatcgtcagaataaccgcaatcagggacgtacagataaaatcgataacgcctggggtgataaatttgagtttatagttttctataacataattaataatgctaccaacagcactgataattatggtgtagattaaaaattgcaccgcatggaataaaaatccttttcttttacgatttccacggcgaaaccaaaagctcatcagaatcaatgctgcgcagctaccgaaaataatgaccagattaagcgcattatttgtaaacagttcagcgatcattgttttatcaggctcctccagataattgtcgtcatgccggaaacccctggcggggctattttaccgcgacaattcattcagatcatcaatagtcagggaaggaagtagcaacattagctaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaactaatcaatgcgttgattgtaaatccagctaagaggtgaggttttcagagcagacaacggtgaaatgtcatggtattgttacgtttaggtaacaagaaatttgtctgcacaaggattacatcatgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaagtaaaaaataggcccgataactcgggccttgtcagttattgaagagtcgttaatcgtcttcttcgtcatccagttcaacgggtgtctgatactggtcaggtttaatgaccagcaggtcgcagcgaagatgatcaatcacctgttccgccgtgttgccgaggaatgctgctgaaataccggtgcgtcctaccgtgcccagaaccacaatccccgcctgtaagtgctccgccaaatcaggaatcacctcttctggcagacctttttctacgtgcgtcatgttttcattaatgccgaatttctgccgcagggctttcattgccagcaaatgttgcccacgaatggcatcgttataaacgctcgggtcaaattccggcagttcaatcgcgatattaattggcgttaccggataagcgccaaccagatgaacttcggtatggttgacttgttctgccagttcgatcgtctctttgaccagtttttcattgagcgcattatgatacggctcttcactggcgagattcaccgccaccagcgccttgcctccttccggccacggctggtctttcaccatccacaccgggcttgggcatttgcgtaacagatgccagtccgttggcgtaaaaatcaccgcttccagacggtcatgttggtgcgccatttttagcaccaaatcgtgtccgccgctgatcacttcctgaatgatggcttcgaaaggacggttatgccagaccactttaatttcaatgggaacgccagcattgagataatattttgcctgctcgtggatccaggctgtacgctggctgatgacgccctgacgcatagcggtacgttcgtccggggagagcagggtggtcatttcgtatgagaagtcatagatcggcaaaaaggctttaattttgccaccaatccgttgatgtaaataaacagctcgccgcaatgctggttggtcgtcctggttaggatcgataacaacgagcatgttctgatacatagccatacagggtctccttacaacaactgtcaacgcagtttgtaattaaaagattaacccatatctggtgaatgaaacagtgatgaaccttctgccagatcaataaatcagaaaaatttaatgatatgacagaaggatagtgagttatgcggaaaaatcaggcaacgttacgcgtatgaccagcaagctgggccagcgcatcgttattttcgatggtgatgtatttacctttgactgccagcatgccgcttttctggaagcgacccagcagacggctgatggtttctaccgtcaggcccagatagttaccgatatcgccacgagtcatcgtcaggcggaattcacgaggggagaagccgcgttgggcaaaacgacgggacaggttgtagatgaatgcagccagacgttcctcggcatttttcttcgacaacagcaggatcatgtcctgatcgcctttgatttcaccgctcatcagacgcatcatctgctgacgcagattcggcattttaccggacaaatcgtccagcgtttcgaacgggatttcacataccatcgaggtttccagcgcctgcgcgaagctcgggtgatggccgctgccgatggcgtcaaatcccaccaggtcgcctgctaaatggaaaccagtgatttgctcgtcgccttgctcagtgatggtataacttttaatcgtaccggagcggatggcataaagcgatttaagttcatcaccagccttaaacagcgtctggcctttctgaataggcttcttccgctcaatgatattatcaagctgatcaagctcatgttcgttgagtgtgaacgggatgcaaagctggctgatgctgcaatcctggcaatggatagcacaaccgccagactgaatgcgccgtataattcgcttttccgggatcataggtctgctcaagccgtaattgatatttgtcaattttaacatctttttagggagcaagtaagtctaagcaaaccttaacagcagagaattccgatattagatgtaaatatatgtctatctatttgaaaacccttaagttgttaagggtaactttacataaaagtgtgaacaagctggcacaaattgtttaatgtttacagcaaaagataaccttcatggcgcaataaccactcttttcgctgaactccgcctgcatatccggtcatggtgccgtttcggccaataacccgatggcaaggtacgacgatgctgatgggattcgatccgtttgccgcaccaacggcacgcgccgcgccaggacggcccaattgctcagccagttggccgtaatgcattacctgcccgcaggggatagtgcgtagtgttttccagacttcgcgctgaaatggcgtcccccccgtagcagtgggaagcgtatcaataatgctaagattaccggcaaaatattcacgaagcttgtcgcttaaaccgcctggattggtggcagaaatgcgctcatagccttctttgcgataatggatgtccagcagctgcaccatgcgttcgctgtactcttcccattcaaccgcccgcaggcgaaattgctcatcgcaaatcacccacagtggacccagtggcgtggcaattttttcttcaagtaatctcagcatccgttctctcttaagacaaacgtgggtaaatacccggacctatcggcagaccgacaagataccacgccagcaacatcagcagccataccaccaaaaagataagtggatagggcaagactaacgaatagtaagtacccagtttcgcgtctggtttgtagcgttgcaggaatccaagaaacagtggaacaaaaggagataccggcgctaaaggcaatacggatgagtcggcaatacgaaagaggatttgcgcaaatgccgggtgaaagccaagtagcataaacattggtacgaaaatgggggcgagaatcgaccagattgcggaaccgctggcaataaacatgcataagaaagaggaaagcaacgccagaccgacaaacgccgggatgccgctaagccctgaactttccagtatatcggtcagccccacggcgatgaatttccccatgttgctccagttaaacatggcgacaaattgggcgaggggaaaaaccatcacgataaatcccgccatctctttcatcggttcaatcattaaatgcggtaaatccgcctgacgtcgaattgtgcgggtagcgatgccataagccagcgagacaacaaagaaaaaaagaatgatcagtggcacgatacctttaataaagggtgatggcatcacggtgtgattaatcggatcgcgcaatatcccgttttgcgggatcaccatcagcgcaatcgcagcaataaaaagtagcgatacgacacctgctatgcgtaaaccaaaacgctgactttcggtcaatgtctgcagtttctcatcgctgtttccctgccattgacctaaccgtggctcgatgattttgtcggttatcaggccgccaacaatcgtcagtacgactacggagctggccataaaataccagttatcaattacactgacgtgcatttgcggattgaacgcagctgccgcttccgtgctgatccccgacagcaacacgtcggttgtgacaatcagtaaattagccgtaaagccgcaacctacgcctgcaatggcagccagtaaacctgcaactggatgcctgcccaccgccagaaaaatcagcgcacccatcggtggcatgatcactaacgccgcatcggaagaaatgtggctgaaaaaagcaataaacagcaccatataactggcgtagcgggcattaacatgcgatgccattttaaccattagtgctggcagtaagccgacgcgctccgccagaccggcacctaaaaccagcgccaggatcgcaccaagtggagcaaaaccgctaaagtttttaataacattgggtaaaaaccagtgtaatccttccacactgagcaggtttttcaccacgaccggcgtaccatcggtcgggtttttcgcactgacgccaaaggccgacaaaattgccgtcgtcaccatgagtacgataatcaaatagataaagagcagaaaaggatggggaaccttgttaccaattctttcgacccagccatagagcttcccggattgggaggacgacggtatggatgacatactcatgggcattcctcggttgttgtgtttgcgttgttgttgttattttaaaggtgacggtgtcacgtttttcgggatagggcagtgatacggttgcgtgtccgttacttgctgatgctcttgttggcattcttgcaatagccctgaatcaaggaagagattgactgtggttgctgccatagttttcgccgccagcagcattcctttatgagcaatagatgttcgcccctggctaaccagttgccacgtatgtagcggtgtaccgacggcaaaacaggggctgaaacactgggcaacaggcagtttccaactgacgtcgccgacatcagtcgatgccgcaagcacgttatcggtggcggcatatggagcgacttcattcgccagtaccgtttcacgatgacgtagtgcaaaaaccttgccgttttcgccaccggttgcggcgatattattcagactgttttgccgatcgttggaggtgagcgtagcctgaatttgtttcgcaaaagccagttcttcggagttccattccggggtaccaaaatgggatagggcctggtacatggcattttctaaggtgcgattcgggagataactggaacaggctttgtcgaagcggcattcaaccgtggtttcggtcatcaatgccgcaccttcggcgattttggcgacccgatcataaatatgctgcacgtcggtcatttcgggggcgcggataagataaagcacttctgcctgcgcctggaccacgttgggcgagatcccgccgctatttgtgatggcatagtgtacgcgcgctttttcaataatatgttcgttgaggaagttggtgccagtggtcatcaacgttacggcatcaagggcgctgcgtcccaaatgaggggaattcgcggcatgtgctgcgatccctttaaagcgccatgatgcctgaatgtttgccagcgtgcgggtattgaacataccggcaaaggcttccgggtgccaggtgagtgccgcatccacatcatcaaataccccctcgcgaaccatgaacgttttacccgagccgccttcttcgccaggacaaccataaaagcgcaccgtgccgccttgcccatattgttccagccatttcttgacggctattgcagcggcaaaggcggcggttcccagcaaattgtgtccgcaaccgtgaccattttcaccgggcgtcacggatgtaggttgcgcgcaacctgcttgctgacttaaacctgccagggcgtcatattctcccagcagggcgataaccggtttgccttgaccaaacgaagcaataaaggcatttgggatattgcctacgttgcgggtaacggtgaagcctgcagattccagcgccgaagccagatgctccgctgaccagaactcttcaaaacgtgtttctggatgatcccagatttgatcggcaatatcggtataacgttggcgatcggcttcaatcgcatcgtcgataaaacgatagatttcctgcatcagatacctcgcgtccagggaaaattgagcgcggtgcgcgccagcgtttcgacggcaatagcgagaacctgctcgtcaaaatcgaatttttcgttgtgatgacctgccgccagctgtgtgccaaacaccacgtaggaggcttgcccttgatgttgctgcacgcgggccatcattaatgtggcatcttcggaacccgcaggcgcttcaacacgttcaatggcctgattgacccccgcgacctgagccgcctgactttgcaaccatgcgacccattgcggcgaaggagaactggcggtagctgcacccatcagacgagtttcaacgccgacaccatacatggttgctgcgccctgaatcgcttgttgtgcacggtcaaaaacatattgattaatgacgtcgctggccccgcgtgtttccactttcagcaacgccgaggcaggaacaacgttacgaccgcttcctgcctgcataacgcccacgtttactctggaagctccttcgctgtgcggggcgattgcatgcagtgcaagagtggcttgtgctgccgccaacaaggcattgtgaccgtcttctggttttgcgcctgcgtgagcggcggtaccggtgaagtgcgcgtcaaatttggtggttgccataaaattatcactgccgcacaccacggtgcccgcaggtacgccagtgccaatgtgcacggcagtaaaataatcaacatcatctacgacacctgcatcgaccatcgcccgcgcgccacgcgtaccttcctctgcaggctgaaaaatcagtttgatgacgccatgtagtccggactcgaactgtttaagggtatgcgccagcccaagcccaatggcggtatgtccatcatgaccacaggcatgcatcattccggcgttacatgacgcaaaaccgtcgcggtaggggcgatggctgacatcctgctcttcactgagatccagcgcgtccatatcgacacggaaagccatcaccggaccggggcgaccggtatccagggtggcgacgataccagtgaaaccaccttcaaaagccgcaatccattgtgctagcgcaccctgttgacgagcgcgctcgaattcgcgttgtagagtgaattcatcaggtaatcccatccggctactttcattaactacttcgcgacccagcgccagtgaatagccgagctggtgcaattcttccgcaacaagggtggcagtgcggaattccacccagccagactctgcatagtgatgaaaatcacgtcgccagtgcgataattttggggcaagcgaattaacaaattgattcaaagactccataacctttcccgtcatcagtaaaaagtgtgacccggttcacgtagcgatagtttttacttatcactaactgatttttcacagttttaaccgttcataaattaccctgacacaatcatctgcattaaagtagatgccagtttctttggtctgataaataacggttatcggtggcgtcatggcttttcaggtaaaaattcatcaaattcgggcttttgttgaagtggctcgtcagggcagcattcgcggagcgagccgaatgttgaatatgtcgcaaccggcactgagtaaatctattcaggagctagaagaagggttagcggcgcaactcttttttcgccgtagtaaaggcgtgacgttaactgatgccggtgaaagtttttatcagcacgccagtctaattcttgaagagctgcgcgcagcccaagaggatattcgccaacgacaagggcaactggcagggcagattaatatcggcatgggggccagtatttcccgcagtctgatgccagctgtcatatctcgttttcatcagcagcatccgcaggtaaaagtacgcattatggaagggcaactggtgtcgatgattaatgaattgcgtcagggagaattggatttcaccatcaatacctattatcagggaccgtacgaccacgaatttacttttgagaaattactggaaaagcaattcgcgatcttttgccgcccgggacaccccgccattggtgcccgttcgatcaaacagttactggattacagctggacaatgccgacgccacacggcagctactacaaacagttgagtgaattgcttgacgatcaggcgcaaacgccacaggtcggtgtagtctgcgagacgttctcagcctgtatcagtctggtggcaaaaagcgattttctcagcaaactgcctgaagaaatgggctgcgatcccttgcacggacaggggctggtgatgttgccggttagcgaaattttaccgaaagcggcctattatttgattcagcggcgtgatagtcgccagacaccactgaccgcgtcattaatcacgcaattccggcgagaatgcggctatctgcaaagttaaaactgcataaaaaaatagagtctgtcgacatccgccagactctacagtacacacagcagtgcatccgcgtcttaaatccggcattgtctcctctgcgccggtgactgtgttataacggttttaacctttagttgccaattttcttcagtgacagatttcacgaaaatataagttacattattaatatcgtgaatgaataatcatgcataagtattttgcttaaaatatcggcaatatttggaacttattactggaaatttgggtaatacgttgttggaccgacccggtctggttatcatatcgcgctcttaattgcgggaggatgtaacatgaaccttgacgacaaatcgctgtttcttgacgccatggaagatgtccagccgctgaaacgtgctaccgatgtccactggcatccaacgcgtaaccaacgtgcgccgcagcgtatcgacacgctgcagcttgataatttcctcaccaccggatttctcgacatcatcccactaagtcagccgctggagtttcggcgggaagggttgcaacatggggtgctggataagctgcgcagtggtaaatatccgcaacaggcgagcctgaatcttttgcgccagccggtggaagagtgccgcaaaatggtgttcagttttattcaacaagccctggcggatggtttgcgtaacgtgctgattattcatggtaaagggcgggatgataaatcgcatgccaatattgtccgcagctatgtggcgcgctggctgaccgaatttgatgatgttcaggcatattgcaccgcgctaccgcatcatggcggcagcggggcgtgttacgtcgcactacgtaaaacggcgcaggcgaagcaagaaaactgggagcgccacgctaagcgcagtcgttgatctcgagacgcatccgcggcttatgccgccagcacgcggttgcgtccatcatttttcgcccgatacaaagcatcatcaacgcgtttaaacagttcatcgatgctttcatttccttcgtgatgcgccacaccaatgctgacggtaaagcgtggtaagcccgaaatactcacttttgccacgcttacgcggatagtttcagccagcgaaagcgcggtatccagtggggttcttggtagcaataagacaaactcttcgcctccccaacgaaacaccaaatcgcctttgcgagcgcaactttcgagggtgcgggcgagggcgcataacacctcatcacctttagaatgcccatagagatcgttaatgtgtttaaaacgatcggtgtcgatgagcaacaagctgtaatcctgagcgatggcgagatgctgcatttggcctggttccgtaatgtgataaaactgtcgccgattcagtaatccggtcatcgcgtcatggtgagcagcatgttccagctgctcctccagccgtttttgctcagtaatatcatgcacaatacataacatgagcttgtcgccataaatttcaatcggtccggcataggtctgcacatgacgagtcgaaccatccgccagtttatgaacaaaattcaaaggtttatgaccaccgggtaaatgcgagatttcatgcatgataggcatgacgcgacgcccgagcatatttatttcccaggtatgtttctggcacatcgtttcatggttataaccatagaaattgagcgcggcgaggttagcatcgacgatttgtccatctcgtgacgggtcaatcaacaacattggtgcagagttagtcagaaaaaagcgcgcataaaaaccttgttttttgcgctgataatttgccgagcgactggcttttaaacccagcgttgccggcgcttcgataccttcgaaaataatcaccggttctgtttctgtcagctttcgcaaaacaagccgacagctcaatgctgtttcctcttctttacgctgaacagtgaggatttcgataatatcgtgttggttttgcagatcggagaggtatttcggcagttctttttgtgaggagacggaatagggtccggttcgtagctgactaaacgtgaggtcttgcatcaacagtttcgccgcgctattggcataaattaactgttcctcaaagggcgaaacgatccagacaggactggtgagtaagtccagggtattgaagttgtgcgtaatcattgagatcccgttatttttatcaatttttgttgctatccgatcgcaaaaaagccacgtcatatgatcagataattctgataatgatagacgctatttaacacttcacacggtttgtatacggaaaagcattttgctttttgtattcaatttagacagaattttattaatcatttcagggtaatggggtgatgagatgttgcgtaacagggccagaaggctagactacaaaataatgcgttgatgatggaggcactgtggaagcgattaagggatcggacgttaatgtcccggatgcagtatttgcctggatgctggatggtagaggcggcgttaaaccgctggaaaatacagatgtgattgatgaagcgcatccctgttggctccaccttaattatgtacaccatgatagcgcccaatggctggcgacaacaccgctgcttcccaataacgtacgtgatgcgctggcgggcgagagcacgcgtccccgagtcagccgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatctggaagagggcacgggtccgaccgattgcgggggatggctggtggatgtgtgcgatgcgttgaccgatcattccagtgaatttatcgagcagctgcacgataaaattatcgaccttgaagataatctccttgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggccttgacgaaatcgacgcctgtatagcacggactggcgtgatggcggatgaaatcgctcaggtgatgcaggaaaatttagctcgtcgtacctatacaatgtcgttgatggcaatggtctttttacccagtacctttctgaccgggttatttggcgtcaaccttggtgggatccctggcggcgggtggcaattcggattttcaattttttgtattctgttagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttgcaggtgaatgcaacgtcaagcgatgggcgttgcgctccatattgtcttacttccttttttgaattactgcatagcacaattgattcgtacgacgccgactttgatgagtcggcttttttttgcctgttatttatcagcgtctaccctttaagagtccacccaatgaccagagggaaatatgacgacacttatttatttgcaaattcctgtccctgaaccgattcctggcgatcctgttccagtgcccgatccgatccctcgcccgcaacccatgcctgacccaccacccgatgaagaaccgattaaattgtcgcatcgtgagcgtagatctgcgaggatacgcgcctgctaactttgcgtcgatgaccacgagaatagattgtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataatgaaatgttgaattgccgggtgcaagagtaaacatcttattcgggattgccggatgcgacgctggccgcgtcttatccggcctccataagagtagcccgatacgcttgcgcatcgggcgctatcctggttatttcacttcaaccacattcagccgtaactcatccaactgattttcatcttcttctggctgccagcacgccggttgtagtgggatctcttcgcgatcaaacgccagatcacccccgttaaccacttcagaaccgtgggtgatgcctttgaaatcgaacaggttggtatcgcacagatgcgacggcaccacattctgcatcgcgctgaacatcgtctcgatacgccctggataacgtttatcccagtcacgcaacatgtcagcaatcacctgacgttgcaggttaggctgtgaaccgcacaggttgcacggaataatcgggaacgcttttgcatcggcaaatcgctgaatatctttctcgcggcagtaggccagcggacgaataacgatatgtttgccatcatcgctcatcagtttcggaggcatacctttcatcttaccgccgtagaacatatttaagaacaacgtttgcaggatatcgtcacgatggtgacccaacgcgatcttcgtcgcccccagttccgttgcggtacgataaaggataccgcgacgaaggcgagaacacagtgagcaagtggttttgccctctggaatcttctctttcacgataccgtaagtattctcttcaacaatcttgtactcaacgcccagcttttcaagatactcgggcagaacgtgttccgggaagcccggttgcttttgatcgaggttaacagccaccagcgaaaaattgattggcgcgctttgctgcaaattgcgcagaatctccagcatggtatagctgtctttacccccggagaggcaaaccatgatgcgatcgccttcttcaatcatattgaagtcagcaatggcttcgcccacgttacgacgcagacgtttttgtaatttgttcaggttgtattgttctttctttgtaatttgttgattttcttgcattatttcagttctctggtactaaatggggcaaattgggggcaaactttgcaactacgataaccgcgcattcaacatggctatctgttcgtcgttcatgtcatcaatccacataccgtaaatttcatacaccatctgcgcagtttcatgccccatttggctggctataaatgccgggttcgctcctgccgtcaacagccagcaggcaaaagtatgccgcgtatggtacggattacggcggcgaataccagcacgttttactgctgcattccaccttgcccccaaactgcttaccgagtaataaggtttttgttttccgttacacaccctgggcatgaaaacaaaatgcagtttttgcttttcggttctgccgtactcccgatgataaaaggtgatttcgcttttgcgatgatgcccggtcagtttgtattgctccttcagtgcttcaagagcaggctgcagtagtgttactgttcggatcccggcatttgtttttgggggaccgaacatatcaagtatcgtcaggtttcttctgacattcactattcccttttcgagatccacatcctcccacgccagagctgccagttccccgtgacgaagtcctgagtaaacggcaaatttccacaagttctggctctgtcctttttcactttccattaatgcattgaattctgttttagataacggatcaggctttattctgtttcgctgtaatttttttactccttcaaatggtttggttgatataaatcccgactgatacgcaaaacgcaacagcgaacagagcagggcgatatagttatcaactgtgcgcacggttcttccttttttgttggatcttggattatccaggtaaagcgtttctccatgcagcagttcattccggtagtttaagatatcgctataacgaatatgtgatatcggggtactttcacaaattattattctgagtgtttttaattgtgatttcgttttcttcattgtgtttgttgttaactctgtctctttaatttttgtccagatatcacaaagctctccgaacgtttttatgactctcgttgtcaccatttttgccccagtgctggactggggaaaacgtcttaaatactcaaattcaccggagtttatttcatgaactatcagcgctcttaaatttccggcctttttaatattactgtttgtaatctcccagccttttaatgtttcccgacatcgttttcctcgaaacatgaaccagatgcgaatgtatctacctctaatctcgacacctgttggtaatttagacatatcatgagtctttgataaactgatttatctttggatagttgtaccagataatccctcgtttgctgtctggcttacctaaaggagatactcgtttgaagtggaagccctccacccaacagttctggcggtatgcttcaatttgtctggcccccagaccagtgcgaagcatcaggccgtattcaaccatccactcttcattaaagattacttgtgccatcgcatcacctctggcaggcgccaatgttagactgaaattgacgcccgatgttgattattaataatcagctatgaagttttaatttgaatacaatgcaattctcgaggactgaagtttctcgcaattaaaatttatcagttttactttctgctctctggaaacgcctgcttcttttttacctgagagcattttttcgcattctgatttcgttagtttagattttgaatatcttgtccagttagtaggagtgccaccttccttttcaatagtggcggtaattttatacatgaacacctccattattatttccagtggttcgtttattccatctttcgagtgcttctttttcacttccaccataaccggttcgggattcgcatccgttacacttcgctcggtaatatcctgaaatggctttcaccgttactgatggacaaccacaaaatggacatggtttaacattgtcatatctcataatttttctcataaaaaatatttcaagttggcggtgcattacaccgccaggctgaattattcctctgaattatcgattacactgtattccccggttaatacagaggaatctgcaggatcgattgtcagtggttccttttcatccattgatactgcacgctggatctcaattgatacgggcaaatatttgaacaggcgacgaatagccgttttctttgccatttcttcccagtgagttacccacggcccgttattaccagctttactcaggctgcgcaccagctcaatctgtttgcgcgtcataacttcaaactgagtacctccgtctttcagtcttgcgacagcatagacgtgggtaaccggggcatcttcgttttctcccgggcggtgtattaacttttcatcaaggccaaattcgaagctaaactcgtcaccttcacggacaacacgggctgacaggctggcgatttgaccagaacggcgagccagatcaatcatgccgcgatagccaatgattagctgaacgttctttttaccgctcttttcgtttttattaccaaaaggcagtaaatatgcatgaccgagggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagttttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagttcaattttccggccttcttccgcagtgataaccgtttttcctgtgcttgcgcattccatcagaaacgctttctcttcttcttttccggcgtttgtacggcggttaaattcaggtgctacgataaagcggttactgaattcttccggttcaagtacccggcagtggaaagcagttcctaaatcgagcgtttttgtctttgtggtgtccacgggggcatttttacgccacaaatatagtgccggagtatcagcaatgtcatcgagctgagacttactgataccgggacccgcgtggtaattctcattcgaaattccgtaataaatacctggctctatgtcttctacgattacgggatctgcgacttcgccagtttcatcactgcaatcgcgatgcggatcgctgccagcattctcattgtgcggatgttcagcgccttccatttcctccggatcattttccttagcttcaacctgactctcttcatcgaatgtttcctggtatgttgcgtcgcccatcaccgcaccacagtcagggcagttatccccgccagtctggccgcaggcattgcaggctatttccggttcctgttgcactactggctcaggttgattcatatctgggctggttttttccgtttctggctggttctggtacacacaatcgcgagtctggatcccctttacccatttcggatcgttcgggtcgctaattccgtcaacaaattcaccacgtgatgcagcaagcaatttatcgtcatcgacaggattttttgatggaatgtttttccgggcttcatggagttctgcccgcagttcctgatatttcgcatcaacagaatttacctgtgactgagcatccagcggctgcgtgtcctgatgatgttcagttgcgtccggttccattgtttcagcctctccctgttcaactgccgttgttccagatggttgcggtttttcttcatcatcctgttttccttcttctgttactcgctgcggcatcggggcagaggagcgaccgcaggcaatatccacgatttccggatcagggttggcatgatcggtttcagtcagtactttgttcagatattcagtgacgtgcgcggggatgacctcgatcccaattggtgcttcttttacggacgcaaccacgatggcgcgggaataatccagcccgccaggcatggtgatgaatttgtcgcggaaaacagaaaagggcggtttattttcagcgataatttcctcaatgcgtttagcgtgtgccggatgaaggttatagatgtccagatccattgaacgggccagtacgccagtggctacgtcgcgcgccagtgacgtcagatcgtgtacgaaaccttcgccgcgatcggtgaggtttccgccgccagcattagcaccggaagccgtgcgagtgatgtgtgaaacacgattacccttcatccactcttttgtcagcagtcctcgatcggtgtagtcagcgttcaggtatgcttcgaaaaaagcagttatcagtcccaggtttgaattaccaggattagggaaaactttgtcagtgtcacgaaccagtttgtggagttcgcgaatttccagcgggtcgagcaggctggttttgtgggaaacagccagggcagtaacagccggtagttcttcagcccgagcaatgtgtaatgcctggagtccgtcgcgtgaaacgtgcgttaccggtttttcgctgccgtgttgagcaagccaacgaatgggcagttcctggccagaaattgggagtagcatattctcctcaatctcagtcatgtcttcgccgttgacgttggtattgccttgatagtgagcgttgtctggtgctgctcccggttttagttcccatgtcatggagtctttgctgagttgatagcgttcactccaggtaaaatcgatctcaccttcagcgggcaggtcattaacgacaggaaaattcgtggcaacagctttaaaatagctgctcagttttttacctgacttaacgatcaggtagtccagagtggcacaggtcgattcaaaatcgttgcttgcccacaggacgacgtcaggttcaccggatgattttttcgctttccgtaacaggaagagtggttttgtgctcattgttttttaacctcaactcagattaaaattcgttttgttcagtgaatgatcttgccggatacacactgttcatagcctgcgccatacgcaggctatttctttcagatttcaccttttaatttcattgcaattagagttgccagaaattcggcttttttttctgcgggcagattctttccgatatgcaccaggcacatttttttgacaccttcatcaagtgtttttacgttgcctgatggaccatcgatatcaaccacagtgaatggggtttctttattttctgttttaattacgtagccaatgcgctttccttccagattcacctcgtgaacaatgtcatcggtagttacaacagtggcttcataattggtaatcatgtttttctccttaattaaggttgagcgaatacctgccatttctggcataaattcagtttcgaatagtcaattaattaaagttcatgtgccatctggtctttttcggcacaagcttcactgcaatattttctcggttcgtcttttgataaaatcccgtgcatgaagtgaagcattctttcaatagctttgctttcttcaacgtcttttttgcaaaggtggtaagcacattttattttcttagtcatcaccatgactccgcctttacaggtaaaccatcacgaccgaggaagactttaatcatgcggtcagtaatgaatgtttttgtggtcaggttacgaatatatagttttcgctttttaatattgtttgccgaggcaatatatgtccggccttcatgaagaacataatcgccaggagtcacacactgacgtggtatttcatcagttccgaagtgatgtgcaatcataattatctccatttttacaaatgaactttgttgatgcggtgtctggtgcctccaggtgactgcaaccagttaacaattacagtcggctttcccacccaaaccaataaggactaacatgacttttaactgtgccacgtgcgcttagccgcattcaccgcatcacaaaattcactttaaaaagggcggacatcagccgaacttcaagaaaaaaactgatgccgccaggactacacacagcaatgtcgttatttacaaccggaggcgcactcccaccatttaaatttaacagacaagaccgactctttatggatatcggaaatgcgccttcgtgttgtgcccggttttatttcaccacctccgggcttcggtggtctcggctatacccctacagcgagagcttgtgttaacatttcaatacccttacagttgagagttattgatatgttggatgtatttactccattgttgaaactttttgctaacgagccactcgaaagacttatgtatacgattatcatttttggtctcactctctggctgataccgaaagagtttactgtcgcattcaatgcttatactgaaataccttggctctttcagattatcgtttttgccttttctttcgtggtcgccatttccttctcaagattgcgagcacatattcaaaagcattattcattactaccagagcaacgagtattgcttcgtttatctgagaaagaaatcgctgtatttaaagatttccttaaaacaggaaatcttattatcacttctccttgccgtaacccggttatgaaaaaattagaacggaagggcatcattcaacatcagagtgatagcgcaaactgttcttattatctcgtcaccgaaaaatactcccattttatgaagttattctggaacagcaggagtagacgttttaatcgttagcttactgtgtgcttctccaaccatcggcgcgcaccagtttcggttttaaatgttttgcttttggtatacgtcatggcagtgaacgttccatcctggttggggaacacgccgcacaccagggattcgttgttgccgaggtcgattttttgcattttgcgaatctcacatcttgttgctacgtatagcgacttctgcctgccagagatcccagtcgttgctgcgtaaagcctgcacagcctggttgtaagtgataccgcaacaatccatcaaatactgaactacttcgtaatgcaccatcttatctctccccttaacgccgggtggcggaactaactgctgcactgcaaaatttgaatcccgccgtcatgttcatacgcctcgggctggctacttaaccccttaccactgcctggtaactcgaagtattgcccggcgttctgtggggcggggtgggtggtatgctggaactataggtaatgcctaattgattgtcaataggctatgcctaatgttttgagcgtaacctaataggtgatggcgacagcagaaagtgatgggggggttaaataacggaatccaggagttttccgtcagaccatataagtttaagttccagtttttgtgatgttctggcttttccgttcagattcaagagctttcagatacttacccactttcatttccatcgctgctatgtaggcgcgaacatcgtggtcaacccaatctggttctgtagcatttccagataacaggaaagctacaatcgctcttatttcatcagaggctgcttgataaaggttgtttatatctaaaagttcactttttgtatctgaattggtgggggttggtatggggtattcgttaagcccccaatgctctggaccaacaacatcagaaaagaaacgccataattctggaagtttatctttacttatagagcctttcttaatccagtcataaattgatggtggttggactttaaagtggcgtgcgacctccgcctttgatttgacggatcccgatgcgatttttttgttaatggcctgctctatcgctcggcctaagtctttaccactaagcattgcttaatattctcctatgcgcattacattaggcaatccctacccttactgcattaggcacagcctattgacaattgcgttaggcgtcgcctaatatttctgtgtgtttttggagttcattcgatgaaaaaagagaactattcattcaagcaagcttgtgctgttgtcggtgggcaatcagcaatggctaggcttttaggtgtatcacctccaagcgtaaatcaatggatcaaaggggtacgtcaattgcctgccgagagatgtccagcaattgaacgtgcaacaagaggtgaggttctgtgcgaagaacttcgtcctgatattgactggtcatatttacgacgttcggcatgttgttcgcagaatatgtcagtgaagcaactaaatgacagtaacaaatcctcatttgatcatacctgaaacatcaagaggcaaatgattcatgaaaatcaagcatgagcacatcgaatcagtgttgtttgccctagcagccgaaaaagggcaggcatgggtagccaatgcaattactgaagaatatctgcgccaggggggcggcgaattgcccctggttccaggcaaggactggaacaatcagcagaatatctatcaccgttggttgaaaggtgaaacgaaaacgcaaagagaaaaaattcagaagctgatcccagcaattctggcaatccttccgcgcgagctgcgtcaccgactctgcatcttcgataccctggaacgccgtgcattactggcggcgcaggaagcgttaagtacggcaattgatgcgcatgatgatgcagtccaagccgtttaccggaaagcgcatttcagcggcggcggttcttccgacgattctgtcattgttcattaagcaaaagtttccatgctgtttgtgcttattctaagccaccgggcagcatcatacggggcaattatggccgcattaccatacatgcaactgtacatagctgattacctggctgacaccatgcatttgtcagcagaggagcatggtgcgtatttgttgctgatgttcaattactggcaaacaggaaagccaatacctaaaaacaggctggcaaaaattgcccgtctgactaacgagcgatgggctgatgttgaaccatccttgcaggagtttttttgcgataacggcgaggaatgggtgcatcttcggattgaggaagatctggcatcagtcagggaaaaattaaccaaaaaatcagccgcaggaaaagcatctgttcaggccagaagaagcagaaaggaagcagatgttcaaacaaaacaagagagaaatttaacaggtgttcaaacagatgttgaagtggtgtttgaacatgatgtcaacacaaaggcaactaataaagatacagataaagatctaaaaacagatccccccctaaatcccccccgggggaatcgaggtgtcaaaaagtttgaccctctggatattactttgccgaactggatttctgtctcgctttggcgtgagtgggttgaatttcgccaggcattgcgaaaaccgattcgaacggagcagggcgctaacggggcgatacgggagctggaaaaattccgccagcagggtttttcacctgagcaggtgattcgacacagcatcgccaatgaataccagggcttgttcgcgccgaaaggtgttcgacctgagacgttactccgacaggttaacaccgtctcgttaccggatagtgcgatcccgccaggcttcagggggtaactgaccatgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaatttttaccgggagaaaaatttaatggagactgtttttgacgcactgaaagcaatgggaaaagccacatccatagaacttgctgcgcgacttgatatcagtcgtgaagaagtgctgaacgaactatgggaactgaaaaaggctggttttgttgataaaagcgcgtacacctggcgtgtggctgataacaatgttcagcaggaacagccagcgcaggcagaactgccggaagaaatcaccacagcaacagtagcgaaaatctcagagtgcgatttaaccgcgacgattgaacaacgaggaccacaaacggctgatgagctggctacattgtttggtaccacatcacgcaaagtggcttcaacgctggcaatggcaatcagcaaaggtcgtctgattcgcgtaaatcagggcggtaaatttcgttactgcataccgggcgataatttaccagcagagccgaaagcagcatcggtatctccgctctggttatctgcatcgtcgtctgcctgtcatggggtgttaatcattaccgtgataacgccatcgcctacaaagaacagcgcgacaaaaatgccagagaactgaagctggcgaacgcggcaattactgagatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctccgggaacgactggtaatgatgcaggcccaacttgaaggtgctcagcaatacataaccgagcagtgtttaaagtaaaatcttaactacaatatgattcattttgatgattgtttcataaggaacagtgaagtaagatctaagaggagttaaattttatacagtataatcataatattgcagcaaggtggttataattgaaagaatatttagatatgaatacatctcatgtaagagttgttactcatatgtgtgggttcctggtttggctctatagtctttcaatgttgccaccaatggttgtagcattgttttataaagaaaaaagcctgtttgttttctttataactttcgttatatttttttgcattggtggcggagcgtggtatacaactaagaaatctggcattcaattacgtacccgtgatgggtttattataattgtaatgttttggattttgttttctgttattagtgcattccctttatggattgactcagaacttaatttaacgttcattgatgctctgtttgaaggggtttctggaataacaacaacaggagcaactgtaattgatgatgttagttcattacctcgggcatatttgtactatcggtcacagttaaattttataggtggtttaggagttattgttctggcggttgctgtattgccattattgggtattggtggtgcaaagctttatcagtcagaaatgccggggccatttaaggatgacaaactcactccccgcctggccgatacgtcacggacactgtggataacttattctttattaggtattgcttgtattgtctgttatagacttgcaggaatgcctttgtttgatgctatttgtcacgggatttccacagtttcgcttggtggtttctcaactcatagcgagagtatcggatattttaataactatttggttgagctggtggctggttctttttccctgctatcggctttcaacttcactctttggtatattgttattagcaggaaaacgataaaacctttaatcagagatattgaacttcgtttctttctgttaatagccttaggggtgatcattgttacctctttccaggtctggcatataggtatgtatgacttgcatggaagttttattcattcgttttttcttgccagctccatgctcactgataatggtttagctacgcaggattatgcaagttggcccacgcacacgatagtgtttttgctgttgtcaagtttctttgggggatgtataggttcaacttgtggtggaattaagtcacttcgatttcttatacttttcaaacaaagcaaacacgagataaatcagctttctcatcccagagcgttgttgagtgtaaatgtaggagggaagatagttacagatcgtgtaatgaggtctgtatggagtttcttttttctttatactctcttcacggtgttttttatactggtgttaaatggtatgggatatgattttcttacatcatttgcaacagtggctgcatgtattaataatatgggattaggttttggggctactgcatcgtcattcggagtgcttaatgacattgcaaaatgcttaatgtgcatagctatgattcttggtcgccttgaaatttatcctgttattatattgttttcaggttttttttggcgctcctaatatatggctgatttataattgtgagtttaatattatgttgactcactcattgatccaatacctaactttaccagcaacacctccgtccccagtagcactggctgctggggtgcgttttattcataaagcaaggctgtatgagcgagaaattaaagatagtctatcgcccattacaagaattgtcaccgtatgcgcacaacgccaggacgcacagtactgagcaggtggcacaactggtagaaagtattaagcaattcggctggactaatccggtgctgattgacgaaaagggcgaaattattgcgggtcacggtcgtgttatggcggctgaaatgctcaaaatggattctgttccggtcattgttctgtctggcctgacggatgagcagaagcagcgataacgatcagtatcgctcccgtaatgcattaatccgtcgccacattgagaaaatggatgccagtttgcacgtcggaacgaaggagtttgatatttcaaaggtttccgaggtggattctgttgatgatttactcattgataatgccgctcgttatctgctgaaagactggaaaggggttggtgaactggttaatggtgttgaggttgcactggaatatacggcagaacgagggatcgcgctgcttaagcagaatccagagttgtactggcagatccttgcagaagcagccagcatcgcccagggtaaagagcagcagaagcaggatacgataaaaaagccatagctgcccagcggtggttatcggagttcgggggagaaaggggggaaaaggcaagatggaagcgagaaaaactcaggttgccaccgataccggaaccagaaatagacccggtgcttaaggagttgttgtacgcctattcggtaatatcccgtgcccgacgttatgctggaatggctggggtgcctttgcctttatctctgacagagataaatgaatatttagccactcatccggtattgattgagcgcgatgaatttgaagcagtgatctttgcactggatgaccagtattttcaggagcagtgtgtgtagttgttaattacgtacactctgttacagagatgtgatggtgtctttaattaaatcgatgatgctcctggagaaaagcattgcgtggcctcgtaatcgctatatctactattatgtcgcctgaaacccacttcgcggtgggttttttgttgtcaggagttttaataaatggcagagcaaacctcgcgtctcgcaataattattgatagcactggagcgaaaaataatgctgacaatctgacctcctcattagtcaaaatgacgcaggctggggaaactgctgcaaatagcgcagggaaagtgactaaggcaacagaagatgagaagaacgcgctcgcaaaattaaaagcagctattgatccagttggtgccgcaattgatactgtcggtcgacgctattctgaattaaagaaatttttcgataaagggcttattgataaagaagaatatgaatttcttgtccgtaaacttaatgaaaccacagaggaattgagcggggttgcgcaagcgcagagagaagccgagaaggccggaaaacttgctgccgctcagcaggaagcgcaggctcaggcctttcaaagaatgctggacaagatcgaccctctggctgcggcgctaagaaatcttgaacaacagcatgatgaacttaatgctgcgtttgcatccgggaaaataaatggttctcagtttgagaattatagccgaaaaatacaggaaacacggcgagagcttaccggagaggctcaggcagagcgagaagcagcaaaagcgcatgatgaacaggttgttgctttgcaacgtctgattgctcaacttgatcctgtcggaactgcttttaatcgtctggtagaacaacagaaacagctcaatgaagcaaaagctaaggggatgctttctcctgaaatgtatgaggagctttctggaaaacttcgtgctatgcggagtgagcttgaggttactcaatcacaattaagcaaaaccggaatgtcggcaaaacaaacggcttttgctatgcgcatgttgcctgcacaaatgacggatattgttgttgggttgtccactggtcagtcgccatttatggtgttaatgcagcagggcggccattcagctatgcaggagacaagaatcgccagcttacccgttacagcgatacccgctggcatgaagattccgtgcgtaaccgctggttcagcgtgatggtggggccgtctgtgcgcgtgaatgaatggttcagcgcgtatgcgatggcgggtatggcttacagccgtgtgtcgactttctccggggattatctccgcgtaactgacaacaagggaaggtgcgaataagcaggtcatttcttcccaagctgactcgctgattaaaatttcgcggatctgggccgatttttttcccgcaaacacatcgaatcagcctatttaggctattttttccaccatttctggcgttatttccggtttttactgagatctctcccactgacgtatcatttggtccacccgaaacaggttggccagggtgaataacatcgccagttggttatcgtttttcagcagccccttgtatctggctttcacgaagccgaactgccgcttgatgatgcgaaacgggtgctccaccctggcacggatgctggctttcatgtattcgatgttgatggccgttttgttcttgcgcggattctgcttcaaggtttttaccttgccgggacgctcggcgatcagccagtccacatccacctcggccagctcctcgcgctgtggcgctccttggtagccggcatcggctgagacaaattgctcctctccatgaagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataatcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacagcggtcatattctgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttcccaaggggaaaacgcacgacgtgctgaccggaagtgatgacggtcgccacagcaacacgtctctggcgtggggagctggcgtgcagtttaacccgaccgaatccgtggccattgatattgcttatgaaggccccggcagtggcgactggcgcactgacggtttcatcgtgggtgtcggttataagttctgattagccaggtaacacagtgttatgacagcccgccggttcaggcgggcttttttgtggggtgaatatggcagtaaagatttcaggtgtactgaaagacggcacaggaaaaccggtacagaactgcacaatccagctgaaagcaaaacgtaacagcaccacggtggtggtgaacacgctggcctcagaaaatccggatgaagccgggcgttacagcatggacgttgagtacggtcagtacagcgttattctgttggtggaaggattcccgccgtcacatgccgggaccattaccgtgtatgaagattctcaacccggtacgctgaatgattttctcggtgccatgacggaggatgatgcccgtccggaggcactgcgccgttttgaactgatggtggaagaggtggcgcgtaacgcgtccgcggtggcacagaacacggcagccgcgaagaagtcagccagtgatgccagcacatcagcccgtgaggcggcaacccatgcggctgatgctgcggactcagcacgcgcagccagcacgtcagccggacaggccgcgtcgtcggctcagtcagcgtcttccagcgcaggaacggcatcaacaaaggccactgaagcatcaaaaagtgctgccgctgcagagtcctcaaaaagcgcggcggccaccagtgccggtgcggcgaaaacgtcagaaacgaatgcttcagcgtcactacaatcagcagccacatctgcatccaccgcgaccacgaaggcatcagaagctgcgacctcggcccgggatgcggcggcctcaaaagaagcggcaaaatcatcagaaacgaacgcatcatcaagcgccagtagtgcagcttcctcggcaacggcggcaggaaattccgcgaaggcggcaaaaacgtccgagacgaacgccaggtcttctgaaacggcagcgggacagagcgcctcggctgcggcaggctcaaaaacagcggctgcgtcgtctgccagtgcagcgtcaacaagtgccgggcaggcctcagccagtgccaccgccgccggaaaatcggcagaaagcgccgcatcgtctgcttcaacagccacaacgaaggctggcgaagccactgaacaggccagcgcagcagcgaggtctgcttccgcagcgaagacatccgaaacgaacgcgaaagcgtcggaaacaagcgcagaatcctcaaaaacggctgccgcatcgtcagccagttcggcggcgtcatcggcatcatcggcgtctgcttcaaaagatgaggcgaccagacaagcgtcagcagcgaagagcagcgccacgacggcatccacgaaggcgacagaggctgctggcagtgcgacggcggcagctcagagcaaaagtacggcggaatccgcggcaacgcgcgccgagacagcagctaaacgggcagaggatattgcatccgccgtggcgcttgaggatgcaagtacgacgaaaaaggggatagtacagctcagcagtgcgaccaacagtacgtctgaaacgctggcggcaacgccaaaggcagtaaaatcagcctatgacaatgcagagaaacgtctgcagaaagaccagaacggcgctgatatacccgataagggatgcttcctgaacaacattaacgcggtcagtaaaacagactttgctgataagcgtggtatgcgttatgtgcgggttaacgctcctgcaggtgcaacatctggaaaatattaccctgttgttgttatgcgttctgctggctcagtaagcgaactggcatcaagagtcattatcaccacggcaacgcgaaccgcaggcgatccgatgaataactgcgagtttaacggatttgttatgcctggtggctggactgacagggggcgttatgcttatggcatgttctggcaatatcaaaacaatgaacgagccattcactcaataatgatgagtaataagggcgatgatttgcgctctgtgttctatgttgatggcgctgctttccctgtttttgcgtttattgaagatggcctgtcaatatccgcacctggtgctgatctcgttgttaatgatacgacctataagtttggggcaacaaatccggcgactgaatgtatcgcggcggacgttatccttgattttaagagtgggcgtggtttttatgagtctcattcgttaatcgttaacgataacttgtcgtgcaaaaaactttttgccacagacgaaattgtagcgcgtggtggtaatcagattcgaatgataggtggggagtatggtgcattatggcgtaatgatggcgctaaaacttacctgctgcttaccaatcaaggtgatgtttatggtggctggaatacattaagaccgtttgctattgataacgcaaccggcgaactggttattggaaccaaactgtccgcaagtctgaacggtaatgcattaacagcaacaaagctgcaaacgccaagacgggtttctggtgttgagtttgatggttccaaagatattactttaaccgccgcgcatgtggctgcttttgccagaagggcaacggatacatatgccgatgcggatggtggcgttccatggaatgccgaatctggcgcttacaatgtcacccgctctggcgacagctatattctggttaacttctataccggagtcggaagttgccggaccctgcagatgaaggcgcattacagaaatggtggtctgttctaccgttcttcaagagacggttatggttttgaggaagactgggcagaagtttatacctcgaaaaatcttccaccagaaagctacccagtcggcgcaccaatcccgtggccatcagataccgttccgtctggttatgccctgatgcaggggcaggcttttgacaaatctgcttacccgaaacttgcagccgcttatccgtcaggcgtgatccctgatatgcgtggctggacgattaagggcaaacctgccagtggtcgggccgtattgtctcaggaacaggacggcattaaatcgcatacccacagcgccagcgcatccagtacagatttggggacgaaaaccacatcgtcgtttgattacggcactaaatccacgaataacaccggggcacatacacacagtgtgagcggctctacaaactcggctggagcacacacacactcactagccaacgtgaacacggctagtgctaactccggtgctggtagtgcatcaacaagattgtctgttgtgcataatcaaaactatgcaacatcatctgctggcgcacatacccactcactgtccggcactgctgcaagcgcaggtgcacacgcgcatactgtcggtattggtgctcatacgcactccgttgcgattggttcacatggacacaccatcaccgttaacgctgctggtaacgcggaaaacaccgtcaaaaacatcgcatttaactatattgtgaggcttgcataatggcattcagaatgagtgaacaaccacggaccataaaaatttataatctgctggccggaactaatgaatttattggtgaaggtgatgcatatattccgcctcatacaggtctgccagcaaacagtaccgatattgcaccgccagatattccggctggcttcgtggctgttttcaacagtgatgagtcatcgtggcatctcgttgaagatcatcggggtaaaacggtttatgacgtggcttccggcaacgcgttatttatttctgaactcggtccgttaccggaaaatgttacctggttatcgccggaaggggagtttcagaagtggaacggcacagcctgggtgaaggatacggaagcagaaaaactgttccggatccgggaggcggaagaaacaaaaaacaacctgatgcaggtagccagtgagcatattgcgccgcttcaggatgctgcagatctggaaattgcaacggaggaagaaatctcgttgctggaagcatggaaaaagtatcgggtattgctgaaccgtgttgatacgtcaactgcacaggatattgaatggccagcactgccgtagggtaaaacatataaattctataattagatgtatctttccatttacggcaaggaagggggcttggaagacgtaaagcatctcacaccgagattattttttatatgtcaggtgtctgaagttttgctttggctcttaaaatggtttgccgcgaggttttgaattcccgggcaatggcacttatacttacacctgacttaattcgttcgaataccacctgtttctgttcttcatttaacacaggaggtcgaccaaaacgtttccctgcgccgcgggctcttactatcccggaatgagtgcgttcaagtaaaaggtctcgttcaaattcagcgactgctgaaattacttgcatcatcatttttcctgttggactggtcaggtcaatgccacccaatgctaagcaatgcactctgatacctgtttcggtcagttgttccactgttttcctgatatccattgcattacaaccaaggcgatccagttttgtcacaatcaattgatcaccacatttcaggcgagcaagcaaccggttaaaaccaggacgctcactggttgctgctgagccgctaatgtgttcttcgattatttgctgaggtttgattttaaaacctgcactttcgatttcccggcgttgattttcggtggtctgatccagcgttgatatccgacagtaagcaaaaattcgagacatagtgagactctatacgaaattggtgttcatatcataatgcatctcagaaaataattatgattatttttgtgcatatttgtatgtacacgttcgaaaataaacgaatgcgtatgcaaccccgtaattttggtgagacccaaaatcgattttgtgaaaaatggctttaactcggtttgtttttcgagttccgggcggactcaaggaagaagaatagtgttgcgtgttattttaaccagatttcaagttgtttggtcgtggaaaagtggagcaaaatgttgttaaagtggaaaaatgataaaaaagtaagtttattatattacattttaccatttaaattttggttgtctttaagaactgatatcgctgtttgtaataattctttgttatccagccatgatgttttctttatgtttccttcaatgtaatcaagcaatgttctggtattgataggtcttccctgttttgctacttccactacagcatcccctaggataattcttacttcaggaagctgcgcagggaaccactttagggtgtcttttgatttcatgaagatattccttaaaatattattgattttcattgcgatattgtatgtctgattcaggatatgttgacttatacatcggttttgtctgggttattggatatgccaatccctaattttattagagcatgactaaaaatgctgaatatgataaggagcgaagtgattatcagtatgctgttcatatagcctcgaattagtaatgtgttatatatgatatagttgacaatttttatcctgggtgttcttaaagttcgtagataaacattgtcgtttcaggtatacaggaatgctaacaggtggcggcaaaaatcaggcggtttatggcgcaagctgaagtggcaactgcaaactatcttatgcagagactctacacggattgggtttaaaagtatacatagataacagtttttatctgaagaagaaaaatatcaaggtgatatagcctatatgcctttgatgcggaggaatgaatgtgatgggagtgatgtatctgaatagttgaaaaaccgcagtcacgtcgtatgcaagaacgtgctgcggttggtttgactttgattgagacgttttggaatttttttcggtggcaaaaatggggcaaaacgctgcaaaaggggcaaaaaaggggcaaaaaaagagtggattatcgtagcttattgttgtcgctgatgatatttaacacattgaaaaataagtaaaatacttatgagtcagagagttgtgatttttgcccttacttgttcaggttgtattgttctttcttactaatttcttgattttgcgacatttaaaagcgactcaattcgttatatggcatcagaagagtatgcgtcatgccggaacgcccagcataagaaatctgatataaaaaactgtggcgtgtatggtacggattagaggggaaaatgtcagcacatttgcgaaatgaatcaaaaagcccgcagcaatgtgcgggcgttagtgtcagcgcacaaccagcacggagcactctgcgtgacgcactacagctgcggcgttggaaccgagcagataagtggtgatatccggtcgatgggaagcaatgatgatcatatgagcggggatcttcttcgccaattccagaatgcggtctttgggcgagccttcctcaacatggacatgcactctgtcggttggcagtttaaattttttaatgatctcttccagttgcgatttggcttccgctttcaggtcatccattgccggtaattctgcggaatacgctaaacccagagaggcatagtagggcagtgaaggtattaccgtcaggaaatgaacctctgcatcatcaatctttgcctcttcctcaacgtggctaatcacgcgttgagttaattctgaatcggaaatatcgatagggacaagaatcgttctgttcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgattttatagtcaacgtaggtggacatgtttttattgaaatagtaagtcgcgccaatatcggcgtatttaaccagatctttatcatcaacacctgccgggttgtctgcaccacccgcagcgtgcaggtcacggcctttagacatcaggaaagagactgccggacgcagaccaaaatcaaactggtactgtgcagtgacttcaaaattctgggttttgtttgccacagcataatcgctgtcgccaaacggggtcatattacgcgtttctgaatacatggttgccaggtaaatattgttagcatcgtattttagcccagcagtccacgcgtctgctttatcaccacccgccgcagtatggttaacctggtcattggtgcggtcagaagaggtgtatgccgcaccagcgctaaagcccatgcctaaatcatatgttgtggaaagaccccagccgtcaccgttttcatggcgaacatcacgtccgttgttggtgccttcctgaccattactggctccttcgttgttaccttgatactgcaccgcgaagttcagaccatttaccagaccgaagaaatcagtattacgataagtcgcgacgccattggctcgaccagtcataaagttgtctgcattggtataagagtcaccgccaaattcaggcagcatatcggtccagccttcgatgtcgtacattacgccataattacgtccgtaatcgaaagaaccgtaatctgcaaatttcagcccggcaaatgccagacgggtccatgactggttttttgaagattcagtgttgtttgcctgaatattgtattcccattgaccgtagccagtgagttgatcgttaatttgggtttcgcctttaaaacccagacgcgcatagctctggtcgccatctttcgctgaattatcagaaaaataatgcaggccatcaactttgccatacagatctaatttgttgccgtctttattataaacttcggctgcatgtgcagcacctgcggcgagcagggcaggaattaaaagtgccagtactttgcttttcattgaataaatcctttagttattttatttgccttttatccccatttcggggagtgaaaacatcctaaaggagaagttcagttagccgataaatatcatttgttacgccttaagtaaaaccttaatcaaataattcctctgaaatgataataagtctggtgaatgtatcgaagataatacatacaaaataaaaattatacttttaatttgctatacgttattctgcgcgggttatatgcctttattgtcacagattttattttctgttgggccattgcattgccactgattttccaacatataaaaagacaagcccgaacagtcgtccgggctttttttttagaattggataatccttatccagagcatttaatcggtgttgcttttttccgcttttccggccatttgtgccaggaagtcatagcgtttttgcaaatcagctgcagcatctttccataactgttctgccacttctggctgctgcgaattcagccgacggaaacgttgctcgtgaagtaacgtttcttccggtgcttctgacggcgggcgtgaatccaaggccagcggcagtttgccttcatcggcacgacgcggatcaaagcgatatagcggccagaagccggtagctgtgagttggcgcatctggtcgtggctgagtgccagatcgtaaccatgctcttcacacgggctataagcaatgatcagcgatggccccggatacgcttccgcttcctgaatcgctttcaccgtctggttcagctgcgcgccgagagaaatctgcgccacataaacatgaccgtacatcatcatactgacgccaagatctttacgcgctttacgtttgccgtgctcgccaaatttagttactgcacccagcggtgtcgctttcgacgcctgaccaccggtgttggaatagcattgcgtatccagcaccagaatgttgacgttttccgtcaaactcaatacatgatccagaccgccaaagccgatatcgtaagcccagccatcaccaccaatcagccagattgatttttccaccagtgcatctgcatcacgtagcagttcatgtgcttcggcaacatcgttgagttgctggcgtaaagctgcaacctgttcacgacgaacctctggcgtggcgtctgatttcaacgccgtcagtaattccgccgggattttatcggcaaattgatccagcagacgcagcacgcggacacggtgttgatcgaccgtcaggcggaaaccaaggccaaattcggcattatcttcaaatagagagttcgcccatgccggcccacgaccgttggcatcggtggtatacggtgtagagggcaggttaccgccataaattgaagaacagccagtggcgttagcgatcaacatccggtcgccatagagctgagtcagtaatttaatatacggcgtctcgccacaaccggagcaagcacctgaatattcaaacagcggtgtaatcagctgcgatgtacgaatatcaatacgttccagtttgctacggtcgatttctggcaggttgaggaagaaatcgtaattgattttctcttcttcgacatgttccaggcgagacatcatattgatggctttaatctctggattctgacggtctttcgccgggcaaacttcgacgcacaggttacaaccggtgcaatcttccggtgccacctgcaagacatatttctgcccgcgcatatcacgcgatttcacatccagcgaatgcaggctggcaggggcgttttccatcgcttcaggcggcaccacttttgcgcgaatagctgagtgtgggcaagcggcaacgcagtggttacattgggtacagagttcctctttccagatggggatctcttcggcgatattgcgtttttcccagcgcgtagtgcccatcggccaggtgccgtctggcggcagcgccgaaacggggagggcgtcaccaagcccggcgagcatcgcagcggttacggttttcacgaaatcaggggcggcatcggaaaccactggcggtcgattggcgctgtgcggatttaccggttgcaacggaacttcttctacggattcacgcgccagcgccagagcctgccagttgcgttccaccagatcctggcctttgctactgtaacttttggcaatcgcaccctgcaattctgcgagggcgctatcgccaggcagaatttgcgtcagatggaaaaaagccatctgcatgacggtattaatacgggccgccaggccacattcgcgggcgattttcgccgcgttaatcacatagaagcgcgcttttttctggtttaacacggcctgaacttcttgcggcaagcgcgaccacacttcatctgcgctgtacggcgtgttgagcaggaaaatgccgccaggttttaaacgctcagccatctgatatttatcgataaactgcaactggtggcagccaacaaaatcagcctgggaaatgagataagcggaacgaatcggctgttcgctcactcgaaggtgagaaaccgtcaggccgcccgcctttttggagtcgtaaacaaaatagccctgtgcgtaccacggcgtggaattaccgataatcttgatattgtttttggtcgcggaaacgctgccatcactaccaaggccataaaacaaggcttccagtttcgccgagtttggcagggtgttttccggcaacggcagtgacagattggtcacatcatcgtaaataccaaccgtaaagcgcgctttcggtttagccgcgttgagctcggcaaataccgccagtacacagtctgggccaaattctttggatgaaagaccatagcgcccaccaatgacacggggcagagtttcgcgctcgccattattaaaggcttctgccagtgcggtcattacatccagatagagcggttctgcctgggcaccgggttctttggttctgtccagtaccgccacgctgcgtacggatcccggcagagcttgcagtaaatgtttagcggagaaggggcggtacaggcgaactttcagcacgccaactttttcgccacgggttagcaattcatcaaccacttcttcacaggtgccaatggcagagcccatcaggataatcacccgttccgcttgcggatgcccgtaatattcaaacggctgatactgacgacctgtcgcggcagagaaatcattcatcgcctgttcaacatggtcatagaccgcgttgtaccatgggttggtggcttcgcgagactggaaataagtgtcaggattggcggacgtaccgcggatcaccggatgttccgggttgagtgcccgggcgcgatgagcatcaatttcgacctgcggcatgagatcaagaatcgtgtcatcggccagcgggacaattttattgatttcgtgggacgtgcggaaaccatcaaagaaatgaataaatggcacgcggcttttcagcgtcgcgatttgcgaaatgagagcaaagtcttgcgcttcctggacgtttgctgcacacaacatcgcgcaacccgtctggcgcaccgccataacgtcggaatgatcgccaaaaatagagagtgcatgtgtggcaacggtacgtgccgctacatgcaggacaaacggtgttagttcgcctgccagtttgtacagcgtcgggatcatcagcagcaaaccctgcgatgacgtaaacgatgttgaaagggcacccgtctgcaaagcgccatgcacggtagcgatagcacccgcttccgactgcatttcaaccacgcgtggtgtgtctccccaaacgttctttaagccgtttccggcccaggcatcagcctgttctgccatcgtggaactgggggtaatagggtagatggcgataacttcactggtgcgaaatgcgaccgaagcaaccgcgccattaccgtcaatagtaatcatatgacacccttacattgcgcaaatgaggggcgcacgaaattgctgcgcgcccagtagtaatctttcaattttagcaaatggctttcttctgcattttcgcttttgtgtcccccacatcagcgtaatgaatgttttgatcaaacagagggcaaaaaaatagccataaaaaagtaaaaatgcggggcaacgcgcaggacagctctcgacgccgccctctgtgctgcctattatttatggcggtgtcgtttggcttgaagatcagaggaagaaaagatgcgagcagcgttttgggtagggtgtgccgctttattgttgtcggcgtgtagtagtgaacctgttcagcaggcgactgccgcgcacgtagcgccaggtttaaaagcgtcgatgtccagtagtggagaagcaaattgtgcaatgatcggcggttcgctttctgttgcccgtcaactggatggtacggcgattgggatgtgtgcattacccaacggcaaacgctgtagcgaacagtcacttgccgccgggagctgtggcagctattaattcattaaatccgccagcttataagttaatgtctgttttgcggtcgccagcgttaactggttcgcggtcagatccacttgtgcaccttctttcagcatttcgctaatggtgttatcgagttcattaagctgcgggttagcgcacatcatacgggtcattgccagccctttggctgtcagttcaccattagacagtttgccttcaccgctaaagcggttacacatgctgccggaaatcatcattttttcaccaaagctgatttctggcggatttttatcgctggtcacgggcttaccgtttacgctttccagcacaaagcgatgatgctgtagctgttctggcgtaacagcaattttgtcattacttacacatcccgccatcagcaggcttagcgcaacaaacgcggctactttcttcattgtggttctcaattacagtttctgactcaggactattttaagaatagaggatgaaaggtcattggggattatctgaatcagctcccctggaatgcaggggagcggcaagattaaaccagttcgttcgggcaggtttcgcctttttccagattgcttaagttttgcagcgtagtctgagaaatactggtcagagcttctgctgtcaggaatgcctggtgcccggtaaacagcacgttgtggcaggcagacaggcgacggaatacgtcatcctggatcacgtcgttggatttatcttcaaagaatagatcgcgttcgttctcatacacgtccatacccaacgaaccaattttctgatttttcagcgcttcaattgctgcctgagaatcaatcaatgcaccgcgactggtattgacgatcatcacgccatttttcatctgttcgaaggcggcttcgttcaacagatgatagttttccggtgtcagcgggcagtgcagagagataacgtctgattcagagaacagggttggcagatcgacatactccacaccgagttccagcgccgctgcacttggatacggatcgaacgccagcagacgcataccaaaacctttcagaatgcgcagcatcgccacaccgattttaccggtaccgataacgcctgccgttttgccatacatagtaaagccggtcagaccttccagagagaagttagcatcacgggtacgctgatacgcgcggtgaatacggcggttcagcgtcatcatcataccgatggcgtgttcagcaacggcctctggatcataggctggaacacggactactttcagccccagttcttttgccgcgtcaaggtcgacgttattgaaaccggcacagcgcagggcgatatatttaacgccgtgctttttcagctcttccagcaccgggcggctgccgtcatcgtttacgaaaatacataccgcttcgcagccattggcagttttagcggttttttccgtcagcagaaagtcaaaaaattccagctcaaagccaaaggactcgttcacctgttgcaggtacttcttgtcgtactgttttgtgctataaacggcgagtttcataagactttctccagtgatgttgaatcacatttaagctactaaaaatattttacaaaatttcaaatttaattgaaagctatggcgatattgaaaaattcatcaacaactatgcttagtgtaggcgcaaccttcaactgaacggttaaacatgccacaatacccgtattgaatgcttaatttttcgctaaatcaggatattaactacccatgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaacactcgcgcagtggcaggccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggtaaaactggtgggggaatttgctatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagtcagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccatcgtctgggtacgtgacgcacagcatccctcctttagcggcgcgctgtcactggacgccgggcaaacgctgttcactggcggcagtgtgttaccgccatcaaccttaaaatttagcgtcgatgggcgcgatcctacctatttcctctttaaaggcgatttacatgctggtgagattggcccggttcgggtaaatggtcgctgggacggtattcgtctgcgcggtaacgcctggtggcctaaacaatcactgaccgtattccagccgctggtgccacccgactggaagatgaacttacgcgatggtgaactgtatgctcaggttgcattttctgctgcgcctgaacaaggattccgcgcgggaggacacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcaacatgacccggcgctgttgcggctgaataatctctcatccagcgaactggttagcgccgtcaatccgaaacaattcgccatgtccggggcatttagtggtgcactgccgttatggctgaacaatgaaaaatggattgtgaaagatggctggctggcgaatagcgggccgatgacattgcgactggataaagacactgcggatgcggtggtaaaagacaatatgactgcgggttcagcaattaactggttgcgctatatggaaattagccgttcatcgacaaaaattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggctggagcagaacgcacgtctgccgggaaatgactgtccgcaaggaaaagagtgtgaggaaaaacaatgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgaaactcgtagcgatcttttctgaggtgatgatgaagaaaacattacttctttgtgcgtttcttgttgggctggtaagcagcaatgtaatggcattgactctggatgaagccagaactcaggggcgggtaggtgaaacattttacggttatctggttgcgctgaaaacggatgctgaaacagagaaattagtagccgacattaatgccgaacgtaaagcgagttaccaacaactggcaaagcaaaataatgtgtcggtagatgatatcgcgaaactcgccgggcaaaagctcgtagctcgggccaaaccgggggaatatgtacaagggataaacggtaaatgggtgcgaaaattttaatagcaaaaccgcaatatcgggataacgctacaggagaaggcgattgatctattttcctgaaacaaggtgaatattcaaaaactcctgtcaaattgccttttgccctgaaaaatgcatagtcaaatatctgttttaactaattggcgttgcagtacatgcaacgccaattagttagcggaatttacgtcgatactcgcctggcgtcatcccaaagcgttgcttaaataccgttgaaaaatgactctggtcagaaaatccccaatgaaagccgatgcctgccagtttttcatcatctgcggcatggcgaatcgcatctgcacaaaaatcgagacgacggttacgaatatattgcgcgactaccaaacctttatcggcaaacattcggtacaaactacgtactgacatacctgtctctccggctatccactccgggcgtaatatctcttcgcgaatattatcgtctatcaacgtaaccactttttgaaactgacgttcacgacgaggttgaacagattcccgctgatgaagtaccgggcgcagcagacacaccatcgcctgtagcgcagcttcactttctgtttcagaaagtgccggattattcatgctctcctgtaacaggcgatgactgagttgcaccatgggtaagtcagcgtccagtctttctgcgcagataggtttttgatggggaaaatattgttccagcagagtgcgtggcaaaagtaatgaaatctgtttagaagactcctgccagtaaagcgaacaggggcgtgaggcatcgagtaacgtaatatcgccagcgccaatctgcacctgacgctcatcctgctccattattgcctgaccactaagctgaaaaacggtgtaaaaccaggcatcgtcgctgccttttacttcctgccaggtgcgggataaattcaccccgctggttgtcacggtactcagctttagtcctttggcaaaatgcgtgtccagtacacccgtgtaacgctcagtcagcaggcgtccggtaaaatttccgcatacctgattgatttgggaaagccattgctgaaactcattatccactgcggggttcatggcacgttttcgctctgtgaaatgtatttttattgttgcatttgtgttgcaataaacgaagctaatgagcctgactataggaaataagtcttgtcaggcatagagacataagcggttattgtcacgatttgcggagcttgtcacagctgacaaagcgaatgtcacagcgaaaaaagtgacttttcttgtcgctgcgtacactgaaatcacactgggtaaataataaggaaaagtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaatctggttcgctcataagtaaaaaacggcacctggtgccgtttttttgtctgaaacaatcacttatctttcttcagcgcccctagcgttggcgtttcgtcaaagaagttccatggtttcagcagagtatgtacccattcggtcggcataatcggccactcttcggcgcgggccacatgtgtggtgccggtggtcatccagacaacggcgtcggtgttgtccagcgactcgttatccttactgtattgtccaagaccggtgtcatgagtagaacggttcggatatttgccttccgggaaacgctcgccaggatgataacgcgttacccagagctgcttgtccataaagcttaaacgatgatagatccactcgtccggcgcgaactgggcaccttttgctaccgggtgagtaccacctgcataaggaataatttgataggaaaccggattgcccatgcggttctctttgttcgggttactcaacagacgaatcgtgcccggatcaaatttctgtgcggcatcctgttcattgccgatgttgtactgattaacttgcatggtactggtgcgtgggccaccggcagtattcggttttaccactgggtccatcgccaccaggctgttattctcgccatctacatccagatcgaggcggaaattataaatatgttggtgtgtagtacccacgatattgtgatcgataagcgtgccgtagcgcgtgtcatctttcgccgtctcatcgtgcatggttttcgctttaacacctttcaccgcttcgatgcccgtagcaccggcatcgatgccaatagtgccgttttcatggaagatccagtcaaaaatgtagtcatagttacccactgtactgatccagcgcaccactaactcccggcgttcggtactgacgttgggctggcccatttcctgatgcttatactccggcccggcataacgttcaaataccgcgatagcgcgagggatctccatcggcacgccagtgtagtcggcgatggtttcattaaggagcactgcgttagacggggcatctttaccacgagcaattggtgaggttagcgtgcccataccgtagtcaccagagtccagatacgctttaaagtaccagccaatatcaggatcaccgtaaggcacaatcatgccgccgagagaaccttcgtacatgactttgcgtttggtgccattgtcgttataagtcacggtggagatcatcggcccgacgcgagagttcatgctgaggtgaaaatcccagttccgccagtgaatcatatcgccagtaatggtgtaatttttaccttcaggctcaatgatttgcataggcttaactgccggagcaacgcggtcacggccatcaaatgggcgtgcggtcattggcaccggaactaccggaccttcttcaatcttaacgatttttttctgttctaaatcaacgaccgccaccaggttttcgatgggatgtgcccagtagttgccatcaccgacatcaagatagctgatgactttgagcaaccgggcatcttgtttcaggccatctttaccatcgaaataacctacggtcagcggcgtggtaatcacttttttcgcatcagtaataccgcgtttcttcacggcagcggcaaattcttcactgttgttaataatgttctgcacactggcgaaatcatccagcaacaccataccgtgggcgtctttaatgggttgccaggagagcagtttgttgttttgcagatccaccaccgcttcgatgatatgtttgccgtcgagcataatgacgtcggctttgcgcggctggtcaaccggtttgttttccagcgcaaacgcccagacagcttctttatctggcggtagcagggagatctcagtaaaacgggtattgggtttgaagtccgcggaagctttaacaatttcaacggcctgtttaatttcgtccgcagttagcgcattaagtgggtgagggcgcttttctacctgaaaggtttgatccagcccggactggaaaacatcgttaataaaggtgtcagaaacccaggctttattgtctttcatcactaccggtacttgcagtgccagaggctgaccattaacaattgctgtttgcgcaccaggcttcactttcacgtacgcgccatctttaatcagggtaaagagctgggcgtagtcgtcccactgcacatcggcaccaaattctttaagcgttttatccattggcaccatatgcgcttcaccaccgtgggcaaataccggcgcttgccaggcgaaacttaaggcgactgccaacgccagggttgttttacgggcagaatacagagaggggcttcccattattaacctcgtcagatgttgtgttcttgttagcaaccgcgctctgtgggcggtttagtcaggttcacattatcagtactgatgcaaaggggattgcctgcacctgccaggttgtttggcaggtgtgccagcttttcatacagtggatgccctgaaaatagatgtacacatcatgcataatgtgacaacgtcacaaaacttagtgaaataaaagggcaactattcgccgttgcccttcattcaccgattaatcgacaaaatcaccgtgctgcctggccaccagcgtcagaattgaatacagcgccaccggggtttgatgctgattgaatacctctacagcccattccaccacacctgttggtttttcttctgcgctacgctgttttttcagcgtcttgcgcttacaggtgagacgcacctggatggtatcgcctggctttacgggttcgataaaacgcaagctttccagcccgtagttagcaatgaccggaccgacaccggcatcgacaaacagacccgcagccgcagaaagcacaaaatacccatgcaccacccgctcaccgaaaatagattcggcagcagcaatcttatccatatgtgcatagaaatgatcgccgctgaggcaagcaaagttaacaatatcggcctctgtcattgtgcggcggggagtcaacaggctgtcgcctggttgtagctcctcaaaatatttgcggaacggatgaatacgatcttcttcgactttcgcaccgcgcacccactgtttactgatagcggcaagcatcgtcggactaccctgaacagcggttcgctgcatgtaatgtttcaccgctcgtaaaccgcctaattcttcaccgcctcctgcgcgaccaggcccaccatgtaccagttgtggcagtggggagccatgcccggtggattcttttgccgactcttcattgaggatctgaattcgcccatgcgtacgtgccgcgtcggcaataaactgacgcgcaatttgcggatcagccgtcaccagcgttcccgcaaggctaccgccgcctgcacaagccagttgcagagcatgtcgctggttttgtgctggcatcagcgttgcgacagggccaaaggcttctgttgcatgtaccgccggtgtttcatccggctgcggacagtacaataaggttggcgggaagaaggcacccgcagcagataaatccgcctgaccaccgaggcgaatctcgcatcctgcagccagcaatatgttcactttttcctgcacatcggcacgctgctcagcatttaccagtgcgcccattttcacgccttcctgagcaggatcaccgaccacgactttctgtaatcgcgcaaccagagcatcactgacagcattaaccaatgcctgcggcacaataatccgccggattgccgtacatttttgcccggcttttgtggtcatctcacgcacaacttcacgaataaacagcgcaaactccggttgatccggggtgacatcttcgcccagtacgcagcagttcagggaatcagcttccatagtgaaggggatagatttggcgacgatatttggctgaactcgcagcatctgtccggtcgccgctgaccccgtgaaagtcaccacatcctggctgtccagatgatccaacaagtcgccagcactaccgcagatcagactaattgcgccttcgggaacaagaccactatcgacaattgatttcaccatcgcctgagtcagttgggccgtcgcggtagctggtttgatgatggctggcattccgcccagccacgttggtgccagcttttccagcattccccagcaggggaagttaaaggcgttaatatgcactgccacgcctgactttgaggtcagtaaatggcgcgcggcaaatccaccttctttcgataaggggatcaattcatcttccggccacagcgtatcgtcaggcagctcccggctaccgaggctggcgtaagtaaataacgtcccaatgccaccttcaatatcaacccaactgtctgcccgcgttgcgcctgtttgcgcagaaagagcatagaaacgctctttttcactcagcagatgtttagcgaccgctttaagcatcgccgcacgttcgataaaggtcatagcgcgaagggcgggggcacctttttcaatggcaaactggcgggcagccgccatatcaagaccttcactggtcacttcccataacgcctcgccgctaatagcgtggtgaatcaaacggctacggccccggccagactgccaggtaccggataagaaactggctaactgctgcatcgctactctccagatgtttcacatttctgttgctaatagttaaatcgcgaatcataaaaagcaaaggatcttttaacgaaatgttaactatgcgatctgtatagcaactgcggaaaacattaatgcactgataaataatgatttataaaaatagggtgcgaaatccgtcacagttcaaacatacaaaatttgtgattttacttaactattgtgtaactttcataaaacaatgtgattcgtgtttttaattaattcacgaaaactggaatcgtaaaggtgatgacgtgacccaagaagaacgctttgagcaacggatagcccaggaaacggctatcgagccacaggactggatgcccgatgcttaccgaaagacattgatccgccagattgggcagcatgcgcactccgagattgttggtatgttgcctgaaggtaactggatcactcgcgcaccaaccttgcggcgtaaagccattctgttggccaaagtgcaggatgaagccggtcatggtctgtatctctatagcgccgccgaaacactgggctgcgccagagaagacatctaccaaaaaatgctcgacggacggatgaaatattcctccatctttaattatccgacattgagttgggctgatatcggtgttatcggctggctggtggatggcgcagcgatcgtcaatcaggtggcgttatgccgcacttcttatggcccgtatgccagagcaatggtgaaaatctgcaaagaagagagttttcaccagcgtcaggggtttgaagcctgcatggcactggcgcagggcagcgaagctcaaaagcagatgttgcaagacgccattaaccgtttctggtggccagccttaatgatgttcgggccaaacgatgataactcgccaaacagcgccagaagtctcacctggaaaatcaaacgtttcaccaacgacgaactccgccagcgtttcgtggataacaccgttccacaggttgaaatgctcggtatgaccgttcctgacccggatctgcattttgacactgaaagcggtcactaccgctttggtgagatcgactggcaggagtttaacgaagtaattaacggtcgcggaatttgtaatcaggagaggctcgacgccaaacgtaaagcctgggaagaaggtacctgggtacgggaagcagcgctggcccatgcacaaaaacaacatgcccgtaaggtcgcataaggagattcaaaatgagtaatgtttactggccgttatacgaagttttcgtgcgtggcaaacagggcttatcacaccgccatgttggcagtttacatgctgccgatgagcggatggcactggaaaatgcccgtgatgcttacacccgtcgtagcgaaggatgttcaatttgggtggtgaaggcgagtgaaattgttgcctcgcaaccggaagaacgcggtgaattttttgatccggctgaaagcaaggtctatcgccatccaacgttttacaccatccctgatggcattgagcacatgtgaggtcggaaatgaatcagttaacggcttacaccttgcgcctgggcgataactgcctggtgctctcccagcggttgggtgaatggtgcggtcacgcaccggaactggaaatcgatctcgcactggcaaacattggcctcgatttattaggtcaggcacgcaacttcttatcgtatgccgctgaattagcgggagaaggcgatgaagataccctggccttcacccgagacgagcgccagttcagcaacttattgttggttgaacaaccaaacggcaattttgccgacaccattgcacgccagtatttcatcgatgcatggcatgtggcgctctttacccgtctgatggaaagccgtgatccgcaactggcggcgatttctgccaaagcaattaaagaagcgcgctatcacctgcgttttagtcgtggctggctggagcgactgggcaatggtactgacgtatcagggcaaaagatgcagcaggccatcaacaagttgtggcgttttaccgccgaactgttcgatgccgacgagattgatattgcactgagtgaagagggtattgcggttgatccacgcactttacgcgcagcgtgggaagccgaagtttttgccgggatcaacgaagccacattgaacgtaccgcaagagcaggcgtatcgcactggcggtaaaaaaggactgcataccgaacaccttggacccatgctggcagaaatgcagtatctccagcgtgtcttgcccggtcagcaatggtaacagaggagatgggtatgcaacgtctggccaccattgcaccgccacaggttcatgagatatgggcgctactcagccagatcccggacccggagatcccggtgctgaccattactgatttaggcatggtgcgtaatgtgacacagatgggagaaggatgggtgatcggctttacgccgacatattccggttgtccggcaacggaacatttgattggcgcgatacgtgaggcaatgacaaccaacgggtttacccccgttcaggttgtgctgcaactcgacccggcatggaccaccgactggatgacccccgatgcccgtgagcgtctgcgagagtatggcattagcccgcccgccggacacagttgccatgcccatttgccgccagaagtacgttgcccgcgctgcgccagcgtccataccacacttatcagtgaatttggttccacggcctgcaaagcattgtaccgctgcgatagttgccgcgaacctttcgattatttcaaatgtatttgaggatgccatgacaacgtttcattccttaacagtggcaaaagtcgagtcggaaacccgtgatgcggtgaccattacctttgcggtgccccagcctttgcaggaggcgtatcgctttcgccccggtcaacatttgaccttaaaagccagctttgatggtgaagaattacgccgttgttactccatttgccgcagctatctgcctggcgaaattagtgtggcggtgaaagccattgaaggcggacgtttctcccgctatgcccgcgaacacatccgccagggtatgacgctggaggtcatggtgccgcaggggcatttcggctatcagccgcaggccgaacgccaggggcgctatctggcaattgcagcaggatcaggtattacgccaatgctggcgattatcgccaccactttacaaaccgagcctgaaagtcagttcaccctgatctacggtaaccgtaccagccagagcatgatgtttcgccaggcactggcagacctgaaagacaaatatcctcagcgtttacagttgttgtgcattttcagtcaggaaaccctcgacagcgatctgcttcacgggcgtattgacggtgaaaaattacagtcacttggggcctcgctcattaattttcgtctttatgatgaggcatttatttgtggtccggcggcgatgatggatgacgcggaaaccgccttaaaagcactgggaatgccagataaaaccattcatctggagcggtttaatacgcctggcacgcgcgtcaaacgtagcgttaacgtgcaaagtgacggacaaaaagtgactgtacgtcaggatgggcgggatcgggaaatcgtgcttaatgccgacgatgaaagcattctcgatgcggcattgcgccagggggcggatctgccctatgcctgcaaaggcggcgtctgtgcgacctgcaaatgcaaagtgctgcgtggcaaagtggcgatggaaaccaattacagtctggaaccggatgaactggccgcaggttatgtgttgagttgccaggcactgccgctgaccagcgatgtggtggttgactttgacgcgaaggggatggcatgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgctggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaatgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatagcatgatgataaatgtgcaaactgtggcagtgattgggagcggcaccatgggggcaggcattgctgaagttgctgccagtcatggacaccaggttttactgtatgacatttctgctgaagcgctgacccgcgcaatcgacgggatacacgcgcggctaaattcacgcgtgacgcggggaaaactgactgctgaaacctgtgaacgcacattgaaacgcctgatcccggtgaccgatattcacgcgctggcagctgcggacctggtcattgaagcggcgtctgaacgtctggaagtcaaaaaagcgctctttgcacagctggcggaagtttgcccgccacaaacgctattgaccactaacacttcgtcaatctctataaccgcgattgctgcggagataaaaaatcctgaacgtgttgcggggctgcatttttttaacccggcaccggtgatgaagttggtggaggtggtcagtgggctggcaacggcggcggaagttgttgagcagttgtgtgaactaacgttgagttggggtaagcagcctgtgcgctgtcattcgactcctggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataaggcctggcaaaatgcccatgcaatgtatgagaacgatgcctgcgccaaagcgcttggcatcgacattatctcaatggatgaaggctttgctgtagtgaccatgaccgtcactgcacaaatgcttaacggtcatcaaagttgccacggcgggcagctattttcactggctgatactgcctttgcctacgcctgcaatagccaggggctggcagccgtcgcttctgcctgcacgattgattttttgcgtccaggctttgccggagacaccttaactgctactgcgcaggtacgtcatcagggcaagcaaaccggtgtttacgacatcgaaattgttaaccaacaacaaaaaacggttgcgctgtttcgcggtaaatctcaccgcatcggcggcaccattacaggagaagcctgatgcgtgaagcctttatttgtgacggaattcgtacgccaattggtcgctacggcggggcattatcaagtgttcgggctgatgatctggctgctatccctttgcgggaactgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacggcagagaatgtagctgaactgttaaaaatctcacgagaagatcaagatagttttgcgctacgcagtcagcaacgtacggcaaaagcgcaatcctcaggcattctggctgaggagattgttccggttgtgttgaaaaacaagaaaggtgttgtaacagaaatacaacatgatgagcatctgcgcccggaaacgacgctggaacagttacgtgggttaaaagcaccatttcgtgccaatggggtgattaccgcaggcaatgcttccggggtgaatgacggagccgctgcgttgattattgccagtgaacagatggcagcagcgcaaggactgacaccgcgggcgcgtatcgtagccatggcaaccgccggggtggaaccgcgcctgatggggcttggtccggtgcctgcaactcgccgggtgctggaacgcgcagggctgagtattcacgatatggacgtgattgaactgaacgaagcgttcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttgagcatatcaacctgcgagtaccctacaatgataaccaatacaaagcttgacccgattgaaaccgcgtctgttgatgagttacaggcgttgcaaacacagcgtctgaaatggacgctcaaacacgcgtatgaaaatgtgccgatgtatcggcgcaaattcgacgcagcaggcgtacatcctgatgatttcagggaactttcagacctgcgtaaatttccctgtaccaccaaacaggatctgcgcgacaactatccctttgacacctttgccgtgccaatggaacaagtggtgcgcattcatgcttcttcgggaaccacaggtaaaccgacagttgtcggctatacgcaaaacgatattgataactgggccaatattgtagcgcgttctttgcgtgcggcagggggctcgcccaaagacaaaattcatgttgcctatggttacggcctgtttactggtgggctgggtgcgcactatggtgccgaacgtctgggcgctacggtgatcccgatgtctggcgggcagacggaaaaacaagcgcaactgatccgtgattttcaaccagatatgatcatggttacgccatcttattgccttaacctgattgaagagctggagcggcagttgggcggtgatgccagcggttgctcgctgcgggttggagtatttggtgctgagccgtggacacaggccatgcgtaaagagattgagcgtcgcctggggatcaccgcactggatatttatggcctgtcagaagtgatggggccgggggtggcgatggagtgtctggaaactaccgacggcccaaccatttgggaagatcatttctatcctgaaattgttaatcctcatgacggcacaccgcttgccgatggtgaacatggcgaactgttattcaccacgctgaccaaagaagcattgccggtcattcgttaccgcacgcgtgatttaacccgactgttaccaggaacggcgcggactatgcgccgcatggatcgcatcagcggacgcagcgatgacatgttgattattcgcggtgtaaatgtctttccgtcacaactggaagaagagattgtcaaattcgaacatttatcgccgcattaccaactggaggtgaaccgccgggggcatcttgattcactttctgtgaaagtggagttgaaagaaagtagcctgacattgacgcatgagcagcgttgccaggtatgccaccagctgcgccatcggattaagtcgatggtggggatctctaccgatgtgatgatcgttaactgtggcagtatcccgcgttcagaaggcaaggcgtgtcgggtgtttgatctgcgcaatattgttggtgcctgacgtatcgtctggccctggtggggtaaagcgccagggccagaagtcgatacgacctgtgctatgattcataaatcacaacaataacaacagactgaagcgaatgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatagacggtctgactccggttgtgccagaagagagttttgtccatccgacagcggtattgatcggcgatgttattctcggcaagggcgtttacgttgggccaaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattacctgattgtcggcagcccggcgaaagcgattcgtgaactcagtgagcaggagttggcatggaaaaagcagggtacgcatgagtaccaggtgctggtgacacgctgtaagcagacgttacatcaagtcgagccattgcgggaaattgaacctggcaggaaacgcctggtatttgatgagaatctgcgaccgaaacagtaacagatgtaaaattattttgtccctttaattataaagcagagttatgtttaagctctgctttatttatttgagtattaattcataccgttttttcatcatataattatttataatgagaatgtggttttaatttgtaatttatattatatacacaatttatatatttcatggtctttttttattcacctgaattataattgtgaattataggaaagtatgtttgattagataataatctactggcaatattggatgtcttctatgttttaaataactaattggtcgggttagtgcatccggctttctttatattcgccagaaggatttattatgcaaaggaaaactctattgtcggcctgtattgcattagctctgagtggtcagggttgggcggcagatatcacagaggtagaaaccaccacaggtgaaaagaaaaataccaatgtgacttgtccggcagacccaggaaaactcagtccggaagagcttaaacgcttaccctctgaatgctctcctttagtcgaacaaaacctgatgccatggctttccacaggcgctgctgcgttaatcacggccttagccgtagtggaactaaacgacgatgatgatcatcatcatcgcaacaattctccactcccaccgacaccccctgatgatgaatcagacgacactccagttcccccaactcctggcggagatgagataataccggacgatccggatgatacgcctacacctcccaaaccggtttcgtttaataatgacgttattctcgataaaacagaaaaaacgttaactattcgcgattcagtttttacttataccgagaatgctgacgggactatatctctgcaagatagcaatggtcgtaaggcaacgattaatctttggcagattgatgaagcgaataacactgttgcccttgaaggggtgagcgcagatggcgcaacgaagtggcaatataatcacaacggtgagcttgttattacgggtgataatgccacagtaaacaacaatggcaaaaccaccgttgacggtaaagattccaccggtacggaaatcaacggtaataacgggaaagtgattcaggacggcgatctggatgtcagcggcggcggtcacggtattgatatcaccggtgacagcgcgacggtggataacaagggcaccatgaccgtcaccgatccggagtccatgggtatccagatcgacggtgacaaggccatcgtcaataacgaaggcgagagcaccatcaccaacggtggcaccggcacccagattaatggtgatgacgccacggcaaacaacaacggcaaaaccaccgttgacggcaaggattccaccggtacggaaatcaacggtaataacggaaaagttattcaggacggcgatctggatgtcagcggcggcggtcacggtattgatatcaccggcgacagcgcaacggtggataacaagggcaccatgaccgtcaccgatccggagtccatcggtatccaggttgacggcgaccaggcggttgttaacaacgaaggcgagagcgccatcaccaacggtggcaccggcacgcagattaacggtgatgacgccacggcaaacaacaacggcaaaaccaccgttgacggcaaggattccaccggtacggaaattgctggcaataacgggaaggtgattcaggacggcgatctggatgtcagcggcggcggtcacggtattgatatcaccggcgacagcgcaacggtggataacaagggcaccatgaccgtcaccgatccggagtccatcggtatccagattgacggcgaccaggccatcgtcaataacgaaggcgagagcactatcaccaatggcggcaccggcactcagatcaacggtaacgacgccaccgcgaataacagtggaaaaaccactgttgatggaaaagattccacgggtaccaaaatcgcgggcaatatcggcattgtaaatctggatggtagcctgactgttacaggcggtgcgcatggtgttgagaacattggtgacaacggcacggttaacaacaaaggagatattgttgtttccgatactggatcgattggcgtgctcatcaacggtgagggggcaacagtatccaatacgggtgatgttaacgttagcaatgaagcgacagggttcagcatcacaaccaacagtgggaaggtttcgctggcaggcagtatgcaggttggcgatttctcgaccggggtagatcttaatggcaacaataacagcgtgacgctggcggcaaaagatctaaaagtggtcgggcagaaagcgacgggcataaacgtttctggcgatgcgaatacagtgaatatcactggtaacgttctggttgataaggataaaaccgcagacaatgcggcggaatatttcttcgatccatccgtgggtatcaacgtttacggcagtgataataacgtgacgctggatggaaagttaactgttgtatcagacagtgaggttacttctcgtcagagtaatttatttgatggcagcgcagagaaaacgtcaggtctggttgtgattggcgatggcaataccgttaatatgaatggtggacttgaactgattggagagaaaaacgcgcttgcagatgggtcgcaggttacttccttgcgcacaggatatagttataccagcgttattgtcgttagtggtgagtcgtcggtatatctgaatggagatacgacaatcagcggagaattccctctggggtttgccggggttattcgggtacaggataaagctttgctggaaattggcagtggcgctacgctaacaatgcaggatattgacagttttgaacatcatgggacaagaaccctggatttgcccctatatttccagacatctgttatcacttaacccattacaagcccgctgccgcagatattcccgtggcgagcgataacccagcgcactatgcggatgccattcgttataatgctcgaacgcctctgcaaggttctttgctgccgttaacccgtctggtttgggcatgatactgatgtagtcacgctttatcgttttcacgaagctctctgctattccgttactctccggactccgcaccgccgtgttcttcggttcaagtcccaacatccgggcgaactggcgtgtttcattagcccggtagcatgaaccattatccgtcagccactccactggagacgacggaagatcgttgccgaagcggcgttccaccgctcccagcatgacgtcctgtactgtttcactgttgaagccgccggtagtgaccgcccagtgcagtgcctcacgatcacagcagtccagcgcgaacgtgacacgcagtctctctccgttatcacagcagaactcgaacccgtcagagcaccatcgctgattgctttctttcacggccactctgcctgtatgtgcccgtttcgatggcggtacagcaggttttcgctcaagcaacagcgcattctggcgcatgatccggtaaacacgtttggcattgatcgcaggcataccatcaagttctgcctgtctgcgaagcagcgcccatacccgacgataaccatacgttggcagctctccgataacatggtgtatacggagaagcacatccgtatcatcagtgtgacgactgcggcggccatccatccagtcatcggttcgtctgagaatgacgtgcaactgcgcacgcgacacccggagacaacggctgactaagcttactccccatccccgggcaataagggcgcgtgcgctatccacttttttgcccgtccatattcaacggcttctttgaggagttcattttccatcgttttcttgccgagcaggcgctggagttctttaatctgcttcatggcggcagcaagttcagaggcaggaacaacctgttctccggcggcgacagcagtaagacttccttcctggtattgcttacgccagagaaataactggctggctgctacaccatgttgccgggcaacgagggagaccgtcatccccggttcaaagctctgctgaacaattgcgatcttttcctgtgtggtacgccgtctgcgtttctccggccctaagacatcaatcatctgttctccaatgactagtctaaaaactagtattaagactatcacttatttaagtgatattggttgtctggagattcagggggccagtctaaaccccagaacttacttatgctgattccggtgcgaaaattgttaataaaggtacttgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctagggcattgggagggcgatttagtctcaggtacaaaaaactctcatatagccacacttgtagaccgaaaatcacgttatacgatcatccttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaacacaaatgggctaattcggcagtactttcctaaaaagacatgtcttgcccaatatactcaacatgaactagatctggttgctgctcagctaaacaacagaccgagaaagacactgaagttcaaaacaccgaaagagataattgaaaggggtgttgcattgacagattgaatctacactgttgaaattcagaatttaggttttgcttttgttactggtgaaaatacaacaggtataaatagtggcacgatctcgttattacaaaatggtaaagatccggcaccgtctcccattgttttactggctactaacggagggagcgccactaatgcaggtacgatcacaggtaaagtgacggaacaacatagcgtatttaacaagtattcaacgggcacatcgaattcatttatttttaataacgatgtcagtagcataacagggttagtcgctcaatcgaatagcacaattatcaatactgacagcggcatcattgatttgtatggtcgtggtagtgtcggcatgcttgctatagcagattcaacagcagaaaatcagggtaaaattacactggattctatgtgggtagatgcaaatgacactaccgcaatgcgagatatagctagcaacagcgccattgacttcggtacaggtgtgggagttggtactgatagttatagtggtgcagggaaaaatgcaacagcaattaaccaattgggcggtgttataactatttataacgccggcgcaggtatggcggcctatggcgccagcaatacagttattaaccaggggacgattaacctcgaaaaaaatggtaattatgacgatagtctggcagcaaatactctggtagggatggctgtttatgagcatggtactgctatcaacgaccagacgggtgttatcaatatcaatgttggtactggtcaggcgttttataacgatggcacaggaacaattgttaactatggtacaatctgcactttcggcgtgtgccaatcggggaatgagtacaataatacagatgatttcacctcactgatctataccggtggcgatacgattacacgaagcggagaaactgtaacgctaaataaatctgctgctgtgactgataagctggctgggaatgttgttaatagcggaacgctttccggtgatcaaattacggtatcaagcggtcttctggaaaataccagcggtggcatcatcaataacttagtaaaacttgacaagggtgccgtcattaaaaatgccggggtgatgacgaataacgtcgatgttagcggtggaatcctcaataatgccggagaaatgactgcgcaaattaccatgaatgctggtgctgatagttcgttagtgaacaacaccggaaccatcaataaaatcgtgcagaacgcgggggtattcaataatagtggcagtgtaacagggcggatgatgtcggctggcggggtctttaataatcaaactgacggggcgattatgagaggtgctgcgctgacaggtactgcagtggcaaataacgaaggaacctggaacctcggaagtagtagtgagggtaacaacaccgggatgctggaagttaataataattcagctttcaataaccgcggcgagtttattcttgataacgacaagaatgctgtgcacatcaaccagtccggtacgctttataataccggtcacatgaacatcagtaattcttcccacaacggagccgttaatatgtggggcggaaatggtcgttttatcaatgacggaacgattgatgtttctgcgaagtcactggtagtcagcgctaataatgccggcgatcagaatgccttcttctggaaccaggataacggggtcatcaacttcgatcacgacagcgccagtgccgtgaaagtcacccacagcaactttattgcccagaatgacggcatcatgaacatcagcggcaccggtgctgtggctatggaaggtgataagaacgcgcagctggttaacaatggcaccatcaacctcggtaccgcaggcactactgacacgggtatgatcggtatgcaactcgatgccaacgccacggcggatgcggtaatcgaaaacaacggcaccatcaatatcttcgccaatgactcgtttgcatttagcgtactgggtacagtaggtcatgtggttaacaacggcacggtggtgattgccgatggggttacgggttctggactgatcaagcagggcgacagcatcaatgttgaaggtatgaacggtaacaacggtaatagcagcgaagtgcattatggcgactatacgttgccggatgtgccgaagcccaatacggttagtgtaacgtcgggaagtgatgaggctggtggcagcatgaacaacctcaacggctatgtcgtcggtaccaacgttaacggcagcgccgggaagctgaaggttaacaatgccagcatgaacggcgtggagattaacacgggctttaccgctggtacggcagacaccactgtgagttttgataacgtagtggaaggtagcaacctgaccgacgctgacgccatcacctcaacgtccgtggtatggactgccaaaggcagcaccgatgccagcggtaacgttgacgtcaccatgagcaaaaatgcctacaccgatgtggcaacagatgcctcggtgaatgacatcgcgaaagcactggatgcgggttacaccaacaacgaactgtttaccagcctgaacgtcggcacgactgctgaactgaacagtgctctgaaacaggtcagcggtagccaggcgaccacggtattccgcgaagcgcgcgtgttaagcaaccgctttagtatgctggcagatgccgcgccgaaagtgggtaacggtctggcgttcaacgttgtcgcgaaaggcgatccgcgtgccgagttaggtaataataccgaatacgacatgctggcattgcgtaaaactatcgacctgagcgaaagccagacgatgagtctggagtacggtatcgctcgtctcgatggtgatggtgcgcagaaagcgggtgataatggcgttacaggcggttatagccagttttttggcctgaaacatcagatgtcgttcgataacggcatgaactggaataacgccttgcgttacgacgttcacaaccttgacagcagccgctcgattgcatttggcaacacgaacaaaacggctgataccgacgtgaaacagcagtacctggagttccgcagcgaaggggcgaagactttcgaaccgagcgaaggactgaaggttacgccatatgcgggtgtaaaactgcgtcacacactggaaggtggctatcaggagcgcaatgccggagactttaacctgaatatgaacagtggcagcgaaacggcggtggacagcatcgtcgggctgaaactggactacgcaggtaaagacggctggagcgctagcgctacgctggaaggcgggccgaacctgagctacgcgaagagccagcgtacggcaagcctggcaggcgcaggcagtcagcactttaacgtcgatgacggtcagaagggcggcggcatcaatagcctgacaagcgtcggcgtgaagtacagcagcaaagaaagttcgctgaatctggatgcgtacaactggaaagaggatggcatcagcgataaaggcgtgatgctgaacttcaagaaaacgttctaatttttagcatgtgatccctaaaccgcaacgctgatacaggttgcggtttttttattgccggatgtggtacgtgacgcgttttgttttgtgtctttcaggacaatagagcaactcatccagtaatcttgtttacaccttcgcattatttatctcttttcgtttctatactgatttttcttaatccgttttattacagggcagggtgcgatgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataacgaatatacaaaagggaaagatgcatttccctttttttcttttttaatggcatggagtgcatatgttgaaggccaggaattgcggctggatacgtttactgcccctgtttatgctgagtctaccagtacaggcggaacttcgatgtgttgcaaatgcagttgatattgaatcatttttttctgcggctaccgctgaagataaacaacaagttgaacaagctatcaacagtagcgtgaatcttgtccccttcggtttatctgcatcgaactggaaagtgcatcgtggcgatttagtggtagaaggtaatatagagagtaatcaaaaattgattgttcttgggaatttgacagtcaaaggtaatatttccactttctctctttctaatccatgggttattctcggtaacgtgacggcaacgaatatagttgcggattcaccactgttaattaccggttcgataaatgcaagtggactggtatttatcgactcatattacgataatccgtctacgattaaggggagtattaatgcgcgtgggatatttatcaatgacataattgcacctgttgttgcgtcttcgacaaatagtgaattcatggtccgtgcgagtgacaaacatgacactgaaaatgtcaaaaaagcgctgatgataataaatcctgatgcatattattgggggctaattaatgatgaagatgctctgaaagaaatttttaagcgaagcaatattcgcatggcagggaatgtctgtaatcagatgaaaaaagaagcgctgtttcgccctaagccttctcctgagttagtgcaagaattgcaaatgctggatgaaggcaaagttgctgcatttgaaggacgagacattgcgacatttgatcttgccgtaatgcgaactctcccaaggcttaaaggaatttcagctaacctacgcaaacaacttattaatagcaatgatgaacaaacgattgaaagtatggcgagatatatgcctgacaatgagattctggagttgaccgatcagcaattgggttaccagcctgttgttctggggttgctcgaccgtgaaccgctctctgtcgaaataatgacgcgaatgagtcgtctacctgatggtgtcggtccgttgaatcttgcgctacgtgaaaatctccctctggatatcgtcatgactctggcgaaaagagattgggatatgatcattcaggagctttataaagatgcgtggttattgcctgaatccattattgatggctatatccgcagtgatgattcctctattcgtcaggtcggtgctggaggacaactcacctacaatcaggcaatgcagttggcgaacgattcatcaaacaatgttgtcacaagcttagcgttcaagctggcagagatgaaacaccatggtcaattgttgcggatgacgccacaagagagtgacaaagttgcaggctatttataccaaaaattcgagaatgacgatgatctaatacgtgtgttatttttagcattgccagataacttacagtttaattttgttaaaaggatggagaaaaaatccccggcctacttttgctgtcgggatatgcaggtaattcactctgacgctgctttacaacggttattgacacgtttcaacgatcctgaagggtggagtaatctggcgaaaaatcagtatctgagcacgtcgatgaaacaaaaaatttggcaacgtgctttatcgcatcggaaaaataatccgaaagcagattcagatgcatatgaaaccagcgctgatatgattttgtctgagctgattagccacggcgaagttgatgaccagatgctattaaatgccaccgccctgatacgttcggacgactgggactttttagagagtgcattaattagttgggataatttacccgctgttgttctcaaggaattacagcaaaacacgccacgcaatgatatttgggcgaagttttttctgaggcaggaaaacagttcccgtgcgcaggttgacgaagcgttacgtgtttattatgcactagaccccgatgcgttagcacaactggatgtactggcaaaacaaccggatcgtatatggtggagtacactggcgaaaagcaatctcacatttttcaagttcggcgcacttaacaaccgccacacaccgcctgcagtactggcggcagaaattgatcccgagtggtggattgtggcgatgaataatccccgttttccagttgatgtattaaaggcgaggctgaaacgtgatcctttgctggcgttagagcttgttaaccctgaactggatttagtccgccagctggcgcttaacggtaagacgcgcgcaatacgggaacaagcgatgagaaaacttgatgagttgtattgatccacaacgtaatgttttttaactatctgattaattggggataatcattcctgacagtgagtccccaataccttgatatattctgaatttttaatgaaacggcgtgttgcgatatctccgtcaggggaattgatgcaccatagcgcaaaccgaattatcaaggattgataatgacgctctaccagataaaaccgctctttcagtcgctgttaaggccgacgatgttttggctttataagcaccacgttacagcgaatcacatcactcttgctgcactggcgctttctcttcttaccggattgctgttgatgttggcggcacaacccatcctctttttgctattgcccatcgtgctttttatccgtatggcgctcaatgcgctggatggcatgttggcgcgtgagtgcaaccagcaaacacgtctgggggcgattttgaatgagactggcgatgttatttccgatattgcgctctatttaccatttttatttttaccggaaagtaacgcatcactcgtgatactcatgttattttgcaccatattgaccgagttttgcggtttactcgcgcagacgattaacggtgttcgcagttatgccggtccatttggcaaaagcgatcgcgcgttaatatttggtctgtggggtctggccgttgccatttatccacagtggatgcagtggaataatcttttatggagcattgcttcaattctgcttctctggactgcgattaatcgttgtcggagtgtgcttcttatgagcgctgaaatataatgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactgaaggaaaatagagaaaatggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagcgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgtttagtcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacccggaggaactcagcgcgttaactccgcggcctacgctggcgattgtctctggcctgtatgagctttttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactgaacgtcggaacgtattgctacaaggcgctggctggttattgttgctggccccgtttttcttcttcacctatggatctcttaatcagttcaccgcggttcaggaccttaacagccatgatatccccagtcaggtattcggttgggaaacggcgatcccttttcttccctggactattgttccttactggagtctggatcttttatatggattttcgctgttcgtttgtagcacgacattcgaacagcgccgacttgtccaccggcttattctggcaacggtaatggcctgctgcggttttttgctctatccgctgaagtttagttttatccgtcctgaagtgagtggggtgacgggatggctattttcgcaacttgaactgtttgatctgccttataaccagtctccttcgctgcatattattctctgctggctactttggcgtcactttcgtcagcatctggctgagaggtggcgtaaagtctgcggcggatggtttttactcatcgccatttcgacgctgacgacctggcagcatcattttattgatgtcatcacagggctggcggtaggtatgttgattgactggatggtgcccgtcgaccgtcgttggaattatcagaaacctgatcaacgtcgaatcaaaatagcactgccctatgtcgtaggcgcgggctcgtgcattgtattgatggagctaatgatgatgattcagttatggtggtcagtctggttatgttggccagtattatcgctactcataattggccgtgggtacggtgggcttggcgcgataacaacagggaaagatagtcaggggaaactaccgcccgccgtttactggctgacattgccctgccgcatcgggatgtggctgtctatgcgttggttttgtcgtcgcctggagccggtgagcaaaatgactgctggtgtttatttaggggcgtttccacgacatattccggcacagaatgcggttctggacgtcacctttgaattccctcgcggacgagccacaaaagatcgactctatttttgtgtaccgatgctggatctggtggttccggaagagggggagctccgacaggccgtggcgatgctggaaacattacgcgaagagcaaggcagcgttctggtccattgtgcattgggattatcgcgcagtgcgctggtggtggcggcatggttgttatgttacggacactgtaaaaccgttaatgaagcgattagctatattcgagccagacgcccgcagattgtgctgacagacgagcacaaagcgatgctgagattatgggaaaacaggtaagtggattgagatgtggactgaatatctacagtccacatcaagaccgtgtccggttatgcagaaacaatgctgtcgatggctgcttttgcgtcagactgtgctttcgctgccatttccggaccgtatgcgatcccttcggcgaagacaaatttcacatcggtaatgccgataaagccgaggaacgtggacagatacggcgtcaccaggtccgttggtccatctttgtggatcccgccgcggctggtaataacgatggcttttttacccgttaccagaccttccggaccgttctcggtatagcggaaagtaacgcctgcgcgggcaaccaggtcaaaatagtttttcaactgagtcgagatgttgaagttatacatcggtgccgcaataacgataacgtcgtgggctttcagctcggcaatcaactcatcggaaagtgccagagcttcctgctgacgcggagtcagcggcgcatcgctcggacgcagagcgccaaccagttcgccatccagtaccggaatcggatttgcagccaggtcgcgaacggtgatttcatcagcggagtgcttttcgcgccattgttcaacaaaataatcggacaactgattagactgagagtaccctgccaggatgctggatttaagaactaataccttgctcatggtgtttccttatagatgtttgaatgggcgatgccccgttgcttgttgacactttattcacaatcctgccacagagatagcgcaataaatcgaagcctatgttcgaatttattgaacaacgcatagaaagccgcgatgtggtactctatatctatcatttaaaagaaaattaatcaggcagactactgcccactaacgttatgacagaacaacaaaaattgacctttacggccttgcagcagcggctggattcgctgatgctgcgtgacagactgcgtttttctcgccgtctgcacggcgtgaagaaggttaaaaatcctgatgcacaacaggccattttccaggagatggcgaaagagattgaccaggcggcagggaaagtcctgctgcgtgaagcggcacgaccggaaattacttatcctgacaatttaccggttagtcagaaaaaacaggacattctcgaagcgattcgtgatcaccaggtggtgatcgtcgccggggaaacgggttctggtaaaacgactcagttaccgaaaatctgtatggagctggggcgcgggattaaaggactgatcggccatacccagccgcgtcgtctggcggcaagaacagtggcgaaccgtattgcggaagagctgaaaacggagccgggcggttgcatcggttacaaagtgcgtttcagcgatcacgtaagtgataacacgatggtcaagctgatgaccgacggtatcctgctggcggagatccagcaagaccgcctgctgatgcagtacgacactatcattattgacgaagcgcacgaacgcagcctgaatatcgattttttgctcggctatttgaaagagttgctgccgcggcgtcctgacctaaaaatcattatcacttccgcgactatcgacccggaacgcttttcgcgccactttaataatgcgccgattattgaagtctccggtcggacctatccggtggaagtgcgctatcgcccgattgttgaagaagccgatgacaccgagcgcgatcagttgcaggcgatttttgacgccgtagacgaactgagtcaggaaagccatggcgacattctgatctttatgagcggcgagcgggaaatccgcgataccgccgatgcgctgaacaagctgaacttacgccataccgaaatcttgccgctttatgcgcggctttcgaacagcgaacaaaatagggtattccagtcgcacagcggacggcgcattgtgctggcgaccaacgtcgcggaaacgtcgctgaccgtaccggggattaaatacgttatcgaccccggtacagcgcgtatcagccgctacagctatcgcaccaaagtgcagcgtttgccgattgagccgatttcccaggcgtctgccaatcagcgtaaaggccgctgtggtcgtgtgtccgaagggatctgtattcgtctctattccgaagacgatttcctctcgcgcccggagtttaccgatccggagattctgcgtaccaacctggcctcggttattttgcagatgaccgcgctggggctgggcgatatcgctgcgttcccgtttgtcgaagcaccggataaacgcaatatccaggatggcgtgcgtctgctcgaagagctgggcgcgatcaccactgatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacgtccgcgctctccattcaggatccgcgcgaacgtccgatggacaaacagcaggcatcggacgaaaaacatcgtcgcttccacgacaaagagtctgactttctcgcgtttgtgaatctgtggaattatcttggcgagcagcaaaaggcgctttcttccaacgccttccgtcgcctgtgtcgtaccgattatctcaactatctgcgcgtgcgcgaatggcaggatatctacacccagttgcgtcaggtggtgaaagaacttggcattccggttaacagcgaaccggcggagtatcgcgaaattcacattgcgttgctgaccggtttactttcccatatcggcatgaaagatgccgataaacaagaatataccggcgcacgtaacgcgcgtttctccatcttccccggttctggtttattcaaaaaaccgcctaaatgggtaatggtggcggaactggtagaaaccagccgcctgtgggggcgcattgctgcgcgtatcgacccggaatgggtggagccagttgctcagcatttgattaaacgcacctacagcgaaccgcactgggaacgggcgcagggcgcggtgatggcaacggaaaaagtcactgtttatggtttgccgattgttgccgcgcgcaaggtcaactacagccagatcgatccggcgttatgtcgtgaactctttattcgccacgcgctggtggaaggtgactggcagacgcgtcacgcattcttccgtgaaaacctgaaactacgggcggaagtagaagagctggaacacaaatcacgtcgccgcgatattctggttgatgacgaaacgttgtttgagttctacgaccagcgcatcagccacgatgtaatctccgctcgccacttcgacagctggtggaaaaaagtcagccgcgaaacgcctgatttgctcaactttgaaaaaagcatgttgatcaaagagggcgcagaaaaaatcagcaagctggattacccgaacttctggcatcagggcaatctcaagctgcgtttgagctatcagtttgagcccggcgcggatgctgacggtgtgaccgtacatattccgctgccgttacttaaccaggttgaggaaagcgggtttgaatggcagatccccggtctgcgccgcgaactggtgattgctctgattaaatcgttgccgaaaccggtacgccgtaattttgtacccgcgccaaactatgccgaagcgtttttaggccgcgtcaaaccgctggagttaccgttgctcgacagccttgagcgcgagttacggcggatgaccggcgttaccgttgaccgcgaagactggcactgggatcaggtgcccgatcacctgaaaattaccttccgcgtggtggatgacaaaaacaagaagctaaaagaagggcgctcgctacaagatctgaaagatgcgctgaaaggcaaagtgcaggaaacgctatctgcggtggcggatgacggtatcgagcagagcggcttacatatctggagttttggtcagctgccggaaagctacgaacagaagcgtggcaactacaaagtgaaggcgtggccggcgctggtggatgagcgcgacagtgtggcgatcaaactgtttgataacccgctggagcaaaagcaggcaatgtggaacggtcttcgccgtctactgctgctgaatattccatcgccaatcaaatatttacatgaaaagttaccgaacaaagccaagctgggactgtactttaacccgtatggcaaagtgctggagctgatcgacgactgtatctcctgcggtgtggataaattgatcgacgccaatggtggcccggtctggacggaagaaggctttgctgcgctgcatgaaaaagtgcgtgccgaactgaacgacacggtggtggatattgcgaagcaggtcgagcaaatccttacggcagtgttcaatatcaacaaacgtctgaaagggcgggtggatatgaccatggcgctggggctttctgacattaaagcgcagatgggcgggttggtatatcgcggttttgtcactggtaacggcttcaaacggctgggcgacacgctgcgatatttgcaggcgattgaaaaacggctggaaaaactggcggttgatccacatcgcgaccgtgcgcagatgctgaaagtcgaaaacgtccagcaggcgtggcagcaatggatcaacaaactgccgcccgcacgtcgtgaggatgaagacgtgaaagagatccgttggatgatagaagagttgcgcgttagttacttcgctcaacaacttggtacgccttatccgatttcagataagcgtattttgcaggcgatggagcagattagcggttaaccctgctatttgcctgataaagaaaaaacccggtaagcatttagcgccgggttttttattaattctaaaacggtaagggtaaaaattcaggaattcagaaaaatacaattctctgctgcaagatgaataatgtttatctacagcatttccttaaaagatatgtcaggcttgcggagtggcggttaaggacatacgatttcctcctttcagagtgctccgcttctcactattatctcacgcagtattcttaagggaacgataaggaggaaccatgaacattaccccgtttccgacgctttcgccggcaactatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccgcactacaacactatccgcaccactggcagagcagaagcgaccatcctggcggatatcgctcatcagttctggcacattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtatgactggggacaatcccgatgcaccacgctggttaagttatcccggattcgttcctcagttaggaaataacgcagacagtgtaatctttattaatcagttacaaggattatggccagttgagcgttatctctcactactcactggcgagctgccgcgtttacgcgatgatagcgatggctacggtccccgcgggcgagattttatcgttcacgttgattttccggcagaagtcatccatgcatggcaaacgctgaaacatgatgcggtgctcatcgaggcgatggaaagtcgctcgttacgttaaaaattgcccgtttgtgaaccacttgtttgcaaacgggcatgactcctgacttttatttctgccttttattccttttacacttgtttttatgaagcccttcacagaattgtcctttcacgattccgtctctctgatgattgatgttaattaacaatgtattcaccgaaaacaaacatataaatcacaggagtcgcccatgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctgtgcgcgtcagagtttagcgaatttttcgagggtgcgaataagctgtgtgacgaagccatattcgttatcgtaccaggcgaccgttttcaccagttgtaaatcgcccacggcggtaatttccgtttgcgtggcatcaaacaccgaaccgaaatggctgccaatgatatcggaagagactatttcttcatcggtataaccaaatgactcgttattggtggttgcttgtttaagtgcgttattcacctcttcggcagtcacttttttccgagaatcgataccagttcagtgaccgaacctgttttcaccggcacgcgttgcgcatgacctttcagtttgccgctcagttccgggatcaccagaccaatggcttttgccgcccccgtagtgtggggaatgatattttctgccgctgcgcgtgaagcacgtaaatctttaccacgcgggccatccaccagtgactgggtgccagtataggcatgaatggtcgtcatcgtgccgacttctatcccgaaactgtcatgcaaggctttggccatcggcgcaagacagttagtggtgcatgacgccacggaaacaatggtgtcgttgccatccagagtgtcgtcattgacgttataaacgatagttttcatttcaccggcaggggcggaaatcaacaccttcttcgcaccagcatcaagatgcgcctgcgatttctcggcggaggtataaaagccagtacattcgacaatgatttctgcacctttcgctttccacggaatatttttagcctctttttcggcgtaaaccgcgatacttttcccatcaacgataagtgaatcttccgtaaaatcaacgctccaggggaatggtccgtagtttgaatcatgtttcagcaggtaggcgagaatttatggggaagtgagatcattaatagcgacaacgtctatgttgcttttgacttcaagtaatcgacccaacaccagtcgaccgatacgaccaaaaccgttaataccaactttactcatggttttctcctgtcaggaacgttcggatgaaaattgatcctttccaagcttagaccaggatggcgggatgggcaatctccattctcacagtgaaacgtaacgtactgaaaacgggtgaacaatatttaatgaaattttgagaaaagcccgttatgttaacggaaaattatgttaaagcaggaaatgttatggaaaataaatattcaaggttacaaatcagcattcactggctggtctttttactggttatcgcagcgtattgcgcaatggagtttcgtggtttcttcccacgtagcgatcggccactcatcaacatgattcatgtttcctgtggcatctcaattctcgtgctgatggtcgttcgtcttttgttaaggctgaaatacccaaccccgccgattatacctaagccaaaaccgatgatgacgggactggcgcatttgggacatttggtgatttatctcctgtttattgcgctgccagtgattggtttggtgatgatgtataaccggggcaacccgtggtttgcgtttggtttgacgatgccttacgcttcagaggccaatttcgaacgggtagatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctgaaggatatttaaagaaaacgcctgtactaaaaccgacccgtggtacaggcgaagaatacgggtctacatcggaagcgcctattatatttatttgtatgataaataaaaccataatccttgcccatacgtccatctggcttatttttaatcaattcacccgatctttgatctcatcaacggtatcaaaataaaccagcgtataacgttcaaatcgaacataagattcgataaaccatggaggttatatgaaaaaactggcacttattttgtttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactgaagtgtaaaaggggtgccatgagaaaatgaatctgctagtcaaatgcgcggggaaaatccccgcgcttgcccttacctggacgtgcaggccatgagcgcagcaacctccttatcaccgtcccggaaccgcagttcgtagagcgtttgtcgggtcaggagtgtgaatgtcagaatcgtaatgcagataatgagcagacacaccaccagagggttgtgcttcatagcctttctccttgccggatggcgggtaagaggctaagatctgaattgctaggttcattcgttggcctcggttgatagaaatatcggtcggggccttcgtctttctgattcccggttagcctgaaaacagaaagtctcaggcacccgcaggcatcctatgaggtttccttagggacgaaaataatcacttcacgaaattgcgtgctgttttccagaatttttcgtcattcgggttagccagtttagccattcgttactctcttcattccaatagcattaattttctatgcaataattgttgtaaaaatgtgacgcaaagaggtttttggtcataagtaattaccgtcaagtgccgatgactttctatcaggagtaaacctggacgagagacaacggtaatgaatacaactccctcacagcgattaggttttttgcatcacatcaggttggttccgttatttgcctgcattctaggcggtatcttagttctattcgcattaagttcagccctggctggctatttcctctggcaggccgatcgcgatcagcgtgatgttactgcggagattgagattcggaccgggttagcgaacagttcagattttttgcgttcagcccggatcaatatgattcaggccggggctgcgagtcgtattgcggaaatggaagcaatgaagcgaaatattgcgcaagccgaatcggagattaaacagtcgcagcaaggttatcgtgcttatcagaatcgaccggtgaaaacacctgctgatgaagccctcgacactgaattaaatcaacgctttcaggcttatatcacgggtatgcaacctatgttgaaatatgccaaaaatggcatgtttgaagcgattatcaatcatgaaagtgagcagatccgaccgctggataatgcttataccgatattttgaacaaagccgttaagatacgtagcaccagagccaaccaactggcggaactggcccatcagcgcacccgcctgggtgggatgttcatgattggcgcgtttgtgcttgccctggtcatgacgctgataacatttatggtgctacgtcggatcgtcattcgtccactgcaacatgccgcacaacggattgaaaaaatcgccagtggcgatctgacgatgaatgatgaaccggcgggtcgtaatgaaatcggtcgcttaagtcgtcatttacagcaaatgcagcattcactggggatgacagtagggactgttcgacagggcgcggaagagatttatcgtggcaccagcgaaatttcagctggcaatgcggacctgtcatctcgcaccgaagaacaagcggcggctatcgaacaaactgccgccagcatggagcaactcactgcgacggtgaaacagaatgcggataacgcgcatcatgccagcaaactggcgcaagaggcttctattaaagccagcgatggcgggcagacggtttccggtgtagtaaaaacgatgggcgctatctccacgagttcgaagaaaatttctgagatcaccgccgtcatcaacagtattgctttccagacgaatattctggcactgaatgctgccgttgaagccgcgcgagcgggtgagcaagggcgtggatttgccgttgtcgccagcgaagtacggacactcgcaagtcgcagcgctcaggcggcgaaagagattgaaggcttgatcagtgaatcagtcaggttaattgacctggggtcggatgaggtggcaacggccgggaaaaccatgagcactattgttgatgccgtcgcgagtgtcacacatatcatgcaggaaatcgccgccgcctcggatgaacaaagtagaggcataacgcaggttagccaggcgatttctgaaatggataaggtgacgcaacagaatgcttctctggtagaagaggcctcagcggcggcggtgtcccttgaagaacaggcggcacgattaactgaggcggtggatgtattccgtctgcacaaacattctgtgtcggcagaacctcgcggagcgggtgaaccagttagtttcgctacggtgtgaaaatgttcaaggagggatcgacagatcccttcacctttcagaacggcattgattttcgaatagcgttaatcatcaactggcaaccagaagagaacgtcgcatctacgcgggtcagtattccaatcggttcgcctgcaccatgtcccggaacaggcagggccaccagcgtggcatgacgcaggtcgtcttttacagcgccagaagggacaaaccacacgtaatcgtattcaaccgtaagttgacgagatagcgaagcagacagcgtttcgatacaacccgaaggaattttacagccctggctctgcactaatgcatctgaatgctggcgtggcgcagtgccttctggtgatacaacgaccggccattccagcacccggcttagcgttacgttctcctgaagtagcgggtgattagggcggacaaccagcttcaacgattcaagaaacagcagttcgtaattaagcccggtcatcagttcaggatctgacatccgaccaatgccgatatcgatttccccggtttttaaacccgccagaatcatagggttactcattgtcgcaacttgcaaggtcgtctctttttgttgctgatgaaactgacctataaccgaaggtaatatccccagtgccgcagtaggtagtgcaccaaccctgacgacatcattattaagaccttctttacgatgaagcgaccgtccggcagtgttgatggcgtcaagaactctgactgcatgcgttaaaaattgttcgccgggtaaggtaagttgcgccccctgacgaccacgctcaaacaagcgagcgccagtcagctgctccagttcattcaatgtcttagagagcgcaggttgactcaaattaagggtttcagccgcgcgccccaaagttccttgttgtgcgacagctacgaatgtatgaaggtggcgcaaacggatgcgctgactaaacagactatttttttccataagcgatgttaaaaacgaagcggtgtcgctgacaagtgaagttgtttgattatgataacttgattgcaaaatattattaacaattaaagcaattatgttacagcaaaatggataatattgatgttttcgcggcgagatcacagtttgtaaattcttcccgcaagagtgaatgcggttacctacactccagattactgaccactggaggcagacactatggcgaacagcatcacggcggatgagattcgggaacagttttcgcaggcaatgtcagccatgtaccagcaagaagttccgcaatatggcacgctgctggaactggtagctgatgtgaatctggctgtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctccttactccgccttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgcattgcacaacgaacatcggttgattgctgatgtggtctgttttcctggatgccatatcaaccacctgacgccacgtacgctggatattgaccgggtgcagtcgatgatgcctgaatgcggaattgaacccaaaattctcatcgaggggccgccgcgccgcgaggtaccgattttactacgccagaccagctttaaagcactggaagagacggtgttgtttgcggggcagaaacagggcacgcataccgcgcgctttggtgaaattgagcagcgtggcgtggcattaacgccgaaagggcgacaactgtatgatgatcttctgcgtaacgctggaaccgggcaggataatctcactcaccaaatgcatttacaggaaaccttccgcacttttcctgacagtgagtttttaatgcgtcagcaagggttggcatggttccggtaccgtctgacgccttcgggtgaggcgcatcgtcaggcgattcatcctggagacgatccacagcccttaattgaacgtggttgggtagtggcgcaacccatcacctatgaagatttcttgcccgttagcgcggcggggatcttccagtcaaatctgggtaatgaaacgcagacacgcagtcacggtaatgccagtcgcgaagcatttgagcaggcgttgggttgtccggttttggatgagttccagctttaccaggaagcggaagaacgcagtaaacgtcgctgtggtttgctttaaaatctgaccatccgcctttgcaaaaatttgcctgattttacaaacgaatcaggctcatcccatcgacataaaaaaaatgccgatttatgcatattctctcagttcaacaattggattattaataaatattgtctagagtgagcggtcataaataagcactttcttgccgctgaaaacgaccagcgcgggaccattcacaacaccagaaggactcactttcaggtatggatcgtagacgatttattaaaggttcaatggctatggccgccgtgtgcggtaccagcggcattgcttctcttttttctcaggcggcattcgcggcagattctgatattgccgacgggcaaacccagcgttttgacttctccattctacagtcaatggcgcacgacttagcgcaaacagcgtggcgtggtgcgcctcgtccgttacctgacacgctggcgacaatgacgccgcaggcttataacagtattcaatacgacgccgaaaaatcgctctggcataacgttgagaaccgtcaactggacgctcagttcttccatatgggaatgggattccgtcgccgcgttcgtatgttttctgtagatccagcaacacatctggcgcgtgaaattcactttcgcccggagttgttcaaatacaacgatgcaggtgttgatacaaaacaattagaagggcaaagcgatctcggctttgccggttttcgcgtgtttaaagcccccgaactggcgcgccgtgatgtagtatcatttctcggcgcgagttatttccgcgccgttgatgatacatatcaatacggtttgtcggcccgcggcctggcgatcgacacttacaccgacagtaaagaagagttccccgactttaccgccttctggtttgatacggtaaaaccgggggcaactacctttaccgtttatgcgttgctcgatagcgccagcattactggtgcctataagttcactatccattgtgagaaaagtcaggtgattatggatgtggaaaatcacctgtatgcgcgcaaagacattaaacagctgggcattgcgccgatgaccagtatgttcagctgcggtactaatgaacgtcggatgtgcgatacaattcatccgcaaattcatgactctgatcgtctgtccatgtggcggggcaacggcgagtggatttgccgtccgctgaataatccgcaaaaattgcagttcaatgcttacaccgacaacaacccgaaagggtttggtttattgcaactggatcgtgacttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcaggtgatgagtttgcattccagtatcgtctgtactggagtgcgcaaccgcctgttcattgcccattagcgcgcgttatggcgacgcgtaccggcatgggcggtttctcggaaggttgggcgccaggtgaacactatcccgaaaaatgggcgcgtcgttttgccgtcgatttcgttggtggtgatctgaaagctgccgcgccaaaaggcattgagccggtgattacgctttccagtggggaagcgaagcaaatcgaaattctctatattgaacccatcgatggttatcgtattcagtttgactggtatccgacttcggactccactgatccggtcgatatgcggatgtatctacgttgtcagggggacgctatcagtgaaacatggctgtatcagtatttcccgccagcgccggataaacgtcagtatgttgacgaccgcgtgatgagttaatcgttttttcttcggcaccttcttcgggaggtgccgtctggttaaacacgatcccgctcgcatttttccctaagttaaatgagtaatctgatggtgtgtatttcagatacaccttgtcagccactaacagggagtgcgtatgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggagagcgtcaaagaggtgtaaactttcctaagccgccagccaggcggcttttttaacaactgcatggattgactggagataagatgactgaaacgataaaagtaagcgaatcacttgaattacatgctgttgcagaaaatcacgtcaaacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcgtttaatcgtattgaaccactgaataaaaccgctgaaataggctactggctggacgaatctcatcaggggcaggggatcatttctcaggcgctgcaggcattgattcatcattacgcccagtctggtgaacttagacgcttcgtgatcaaatgtcgggtggacaatccgcaaagcaaccaggtcgctttgcgcaatggttttatccttgaaggttgcctgaaacaggctgagttcctgaatgatgcctatgatgatgtgaacttatacgcgcgtattatcgattcacaataaccctgccagcggcgttcgcgtaatgcgctcctcgccgttaatgacttttggaccacggacatgaaccgtgtcgccatcaaaggcttcaacgacggcgtggtcggttaactccacatggttttcaattatcaccgcacctgtaatacggctctcaccttgtatgacaacgtgctcgtcgagcagaatcggtccgccacgtaccacggcatttccgccaaccaagacatgatgttttaacacacaattaccttccacaatggcatattccgccacctgcgaactgtaatgaatcgtcggaatggcatcttcttctatgccagctttcacctgcgcgtgaccgtagactttagcgcaatcgcatagccagacattgttctcttcattaccttcaatactggcaaaatcaaaaacttcggcgcgatgttcaataaaagcataccggacgacggcatcgccataaatttgtgcctggtggacaatacgcgaggcgctaacccttgcgcgatcataaatttggagcaggagttgatggtcgggcgttaagccttgtgcggcgacgatcatagaatgttgatcaattaaggcgtgaccaaatattctacattgcccgtaaactaatgagtcatgaatggtgacgctgtcacttatatatgcaccctggctgatttcactattatcgatccagacgttatccgttgcgtaaacctctccccacagcacgctggtgccggtgatacgcgtattaccggaaatcaccgctccgccgaacgcaatagcattctggtcgtaaatccagcaatttccttcttgtgctaacaccgtttcgcgatcgatccagccgccagcggttcctgctatcacatcgttaaaatcgctaatggcgataatctgccgtaataacacattttttttagtgccatcttcctgataactaaaggctcgctgttcttcacttagacgatatttgcgcatagcgttttcccacaggtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccaggtttggcaggtcagccactggttaggggatgggctggtgattctggcgatgatcatctggggattattgactagcgcatttattgcccgactcatacgctttccgcatagcgtgctggcggaagttcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcctggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagccttgaaccggtgatcttgcagcgtctgcgcagttcgggagaattacccacggcactgcggacatcactcggcattcagctcgctcctgcgctggtggcttgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggcgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatgacccggtaagcacaaaacgcgtgaaaattccccacgctgagatgatttactgttcttcttttcggtaagcatattttttatcgaagggatgtgaaattaatcacagtagtcgaagtttttagcagcttaacttactgaaatttaagtactgatgattgacttagcccctttttcggcattgactatgtcgtctgaaaaggggctgaaaaatttattttcaccaacactttttttgccacaacacgaagcggcgctttttgctataacttagaaagtaatataatcatctcaggaaactattcatgcgtaccacatcatttgcgaaagttgcagctttatgcggcttattggctctgtctggttgtgcatctaaaatcacccagccagataaatattctggttttttaaacaattactctgatttaaaagaaacaacctcggctacaggtaaacctgttttacgttgggtagacccgagttttgatcaaagcaaatatgacagcatcgtctggaacccaatcacttattatccggtaccgaaaccgtcgacccaggtagggcagaaagttctggataaaattttgaactataccaacaccgaaatgaaagaagcgatagcgcagcgtaaaccactggttaccaccgctgggccgcgtagtctgattttccgtggggccattaccggtgtagataccagcaaagaagggctgcaattctatgaagtggttcctgttgcattagtggttgcggggacgcaaatggctacaggccaccgtaccatggatactcgcctctattttgaaggtgagctgattgatgcagcgactaataaaccggttatcaaagtcgttcgtcagggcgaaggtaaagacctgaataacgaaagtacgccaatggctttcgaaaatattaaacaagttattgatgacatggcgaccgatgccaccatgtttgacgttaacaaaaagtagttccagacgcgccatcgttagatggcgctttttatccggtgcgccgtaaaaccccatccttcagggcggggatataaggcgcggttttccacctgaccaggtgtttgctgttgttcaatgtattggcggatgacggatattggcgcacctccgcagctactggcaaaatagccaggactccacaaaacgcctttgtagtaatacctgaatgcaatatctggtcgatctcgtcgcagtcacctacccgatacgcctttgaggctgtttaccagactggatatcgccagtttgggaggatagttaattaacaaatggacgtgatctggttcgccatccatttcaaccagttcagcttcaaaatcagcacatacatttgaaaagtaagtgcgtagtttttctgtcgcgtcatggtcaaaaatctggcgtcggtatctggtgacaaagagcaggtgaacatgcatcaggaaaacacaatgccttccacgccggatatcggtttcttttttcacagaccaaagtatcatttgacctgtgaaacgattacaggcatttaaattccagttaagacccggtggtcaacaggagtgtgaaatgaggcgcttcgcaggcgcatgtcgtttcgttttcaatcgtgctctggcacgtcagaatgagaatcatgaggccggtaataaatacatcccttacgggaaaatggcttcctggctggttgagtggaaaaatgccactgaaacgcaatggcttaaagattctccctcacagccattgcaacagtcactgaaagaccttgagcgggcttacaaaaacttcttccggaagcgggctgcttttccccgattcaaaaagcggggacagaatgatgcattccgctacccgcagggcgttaagctcgatcaggaaaacagccgtatttttctgccgaaactgggctggatgcgctaccggaacagccgtcaggtcacgggtgttgtgaaaaatgtcactgtcagccagtcctgcggtaagtggtacatcagtattcagacagaaagtgaagtatcaactccggttcacccttcagcatcaatggtcgggctggatgctggcgtggctaaactcgccacgctgtcagatggcacagtctttgagcctgtaaacagttttcagaaaaaccagaagaagctggcgagacttcagcgacagttaagccgcaaggtcaaattcagcaacaactggcaaaagcagaaacgcaaaatacagcgactgcattcctgtatcgcaaatatccgcagggactaccttcacaaagtcacaacggccgtcagcaaaaaccacgcaatgatagtcattgaggatttgaaggtcagcaacatgtcaaagtcagcagcgggtacggtcagccagccggggcgcaatgtccgggcaaaatcaggtttaaaccgttcgatactggatcagggctggtatgaaatgcgccgccagcttgcgtataagcagctctggcgtggcggtcaggtgcttgctgttccgccagcgtatacaagccagcgttgcgcgtactgtggtcatacagcgaaagagaaccgcctgtcacaaagtaaattcagatgccaggtatgtggatatacagcgaacgccgatgtaaatggcgctcgcaacattttagcggcggggcacgccgttcttgcctgtggagagatggtgcagtcaggccgcccgttgaagcaggaacccaccgaaatgattcaggcgacagcctgaacgtagcagggatccacgtccttcagggcgtggaggatgtcaatatcggtttctgtcagcgattaaattcaacaccacgtaacaaacgcctccggcaattaatccccaaaacgcagaaccaatcccgaccagcgtcaatccacttgccgttaccagaaatgccaccaccgccgcgtctcgctcacgctcattatgcagcgcctgatacaaactgccgccgatggtacttaacagcgccagacctgccagcatctggatccaacttacgggcagggcagccatcatcccggtaatggcactaccaaacagacctgcgagcaaatagaaaatgcctgcaacggcagcggccagccaacgttgatctttatccggatgcgcttccgggctttggcaaatagccgcggtgattgccgcaataccgacggaataaacgccgaaaggggaaaaaaccagtgccagcaatccagtaaatacaattaatggcgaaacaggagccgaatatccagctgctttcattgctgcgatacccggtgcgttttgcgatgccatcgtcaccagaaaaagggggagtgcaacgctcaggctgtgagcaaacgaaaaatcaggggtaatataagtggggagaacgggtttaaagacaacatcagttgtgacaacgtcaccttgcgcgatgacgatcacgatcccaataatcatcgcggcaattaccgcatagcgcggcgcaacggccttggttgccagccataccagcaacatacttccacacaacgtaaattgaccgtccagactggcaaacgcctgtaaaccaaagcgtaataaaatcccggcaagcattgccgccgcaagcgagtgcggaataatgcgcatcagacgagcaaagagtcccgttatgccgcagaggactattagcgcgttggtgacaataaaaacgccgatggcttcgttaagtgttagtccctgcaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttatagcgtacaggcaccgtagcatttgtccgttataacgcacaagtgataaacttccgttttgccggaggagtcgcatggaaaatctcgctcgctttttatccaccacacttaaacaactacgccagcagcgcggctggagtctttcgcgactggcagaagcgacgggcgtttctaaagcaatgttagggcagattgagcgtaatgagtccagtccgacggtcgcgacattatggaaaattgccaccgggttgaacgtaccattttcaacatttatttctccgccgcagtccgctacgccttcagtttatgatccacaacagcaggcgatggtgatcacttcgctgtttccttatgatccacaactctgctttgaacacttctcgattcagatggcatctggtgcaataagcgaatcgacgccccatgagaagggggtaatcgaacatgtcgtcgtcattgatggacaacttgatctgtgcgttgatggggaatggcagacccttaattgtggggaaggcgttcgatttgctgcagacgtcacgcatatctatcgtaatggtggggagcaaaccgtacattttcattccctcatccattacccgcgcagttaagcgggaaaactatttcgcaacgtcgcgcttgtggctaaaatagccgccatttttcagctactggataagaatgtgaccgtatcttctcatcgacttgaactgttaagcccggcacgcgatgccgccattgcccgcgaagctattttgcacggtgccgatgctgtttatatcggcggccctggttttggtgcccgtcataatgccagtaatagcttgaaagatattgccgagctggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgacattcgtacagttgaaaaagcgaagttcctctctgatgttggcttcacgcagattgtgctggcgcgagagctgaatcttgatcagatccgcgcgattcaccaggctacggacgcgaccattgaattctttattcatggggcactgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggtgtacgctccttcaagattgaagggcgttacaaagatatgagctacgtgaagaatatcaccgcccattatcgccagatgcttgatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtaggcgaagtagtgaaagtggcgaaagatcatctcgatgttgccgttaccgagccactggcaaatggcgatggcctgaacgtgttgattaaacgtgaagtcgtcggttttcgtgccaatacggtcgagaaaaccggagaaaatcagtaccgcgtctggcccaatgaaatgccagcagatttgcacaaaattcgtccacatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacgcatacgctggacgggcagttcgacgaagccaataacgccgaaaaagcaatgaacaatctgaaggatggtctggcaaaactggggcaaaccctctattacgcccgcgatgtgcaaattaatttgccgggggcgctgtttgtaccaaacagtctgttaaaccagttccgccgtgaagctgctgacatgctggatgctgcgcgtcttgccagttaccagcgcggcagccgtaaaccggttgctgatcctgcgccggtttatccgcaaacgcatctgagtttcctcgcgaacgtatacaaccagaaagcgcgtgaattttatcatcgctatggtgtgcagctgattgacgcggcgtatgaagcacatgaagagaagggcgaagtcccggtgatgatcaccaagcattgtctgcgctttgcctttaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgagctgctgaaaacattgccgaagcgaaaagggtaaaacgccagttttctggttactcacaacttattgaatctgcatgatattgcctgccgggtaaggcgttacgccgcatccggcatcaaatgactcaacgttgtcccgcttctggtttgcgcgatttttgccagtaaaaatgctcgcgcaaaccttccgccgactcttccgccacagcacgcaattcatcgctgtccgcttcatgacgcagctgatgatccacattctttacccacacaaattcatgtcctttgtgccctgccatgagttgtcctgaaaacagagcacacgttaataagacaaccgataacgccttcgtaaacatcctgccacctttttcttaccttttgccgctatgatgccgatcgtttcttgaggttattattcagttttgcaaattagcgcaaagaaattctggaatcttccttcctgattttgcattgcattctgccgttgcggcgatttagtgctattttcgagcaaattacacacggaggtaaacactaatgtttactttgttgatatactcagcggcagggaggcgatgtgaaacaaagcgagttcagacgttggctcgaatctcagggcgtcgatgtagcgaatggcagcaaccatttgaaactcaggtttcatgggaggcgcagtgtcatgccgcgtcacccctgcgatgagattaaagaaccattgcgtaaagcaatcctgaaacaactcggtttgagttaatcgccaattaaaaaggttaatgacatgcgagagacagtcgaaattatgcgttatcccgtcactcttacacccgcgccggaaggcggttatatggtttcttttgtggatatccctgaagcgttgacccagggcgaaactgtcgctgaagcgatggaagcggcaaaagatgctttactgaccgcatttgatttttattttgaagataacgagcttatccctttaccttcgccattaaatagtcacgatcactttattgaagtacctttgagcgtcgcctctaaggtattgctgttaaatgcttttttacagtcagaaatcactcagcaagagttagccaggcgaattggcaaacctaaacaggagattactcgcctatttaacttgcatcatgcgacaaaaatcgacgccgtccagctcgcggcaaaggcgcttggcaaagagttatcgctggtgatggtttaattacagttaacgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttcaggcatgagctttatgactgtcagccatgcctatcagttgctcgaaagtcagggatatattatcgcacgaccgcagtcgggttattacgttgcgccacaggcaataaaaatgccgaaagcgccagtcattccagtcactcgagatgaagcagtcgatatcaacacttatatttttgatatgttgcaggccagtcgcgatccgtcggtcgttccgtttgcctcggcctttcccgacccgcgacttttccccctccaacaactaaaccgctcgctggcgcaggtaagcaaaaccgccacagcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagcggtaactgaaccgggcgattgggtgatagtagagaatccttgtttctacggtgcgttgcaggcgctggagcggctacggctgaaggcgttatcggtggcgacggatgttaaagaagggatagatcttcaggcgctggaactggcgttgcaggagtatccggtgaaagcgtgctggctgatgactaatagccagaatccactcggatttaccttaacgccgcaaaaaaaagcacaactggtggcgttgctcaatcagtacaacgtaacgctgattgaagatgacgtttacagcgaactttattttggacgggaaaaaccgctgcctgcgaaagcgtgggatcgccacgatggcgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcaacttgcgctggtggattacctttccacgcgccgatacgacgcccatcttcgtcgcctgcgtcgccagcttgcggaacgtaaacaacgtgcctggcaggcactgctgcgttatctgcctgcggaagtgaaaattcatcataatgacagtggttactttctctggttggagctccccgagccgttagatgccggcgaattaagcctggcggcactgacgcatcatatcagtattgcgccgggtaaaatgttttctaccggtgaaaactggtcacgttttttccgttttaataccgcgtggcagtggggagagcgtgaagaacaggcggtaaaacaattaggcaaacttattcaagaacggctgtaatagcgtttaatttaattcctcttagattgggtaatatgaatttcgaatagcagtcatatttcctaactccttgactatactccagaagataaccttacagacggcataatgcgcggtagctcacaacctgaataaattttctcaggggcgaaggtgtgcctgcaagccgccgtctatggttaaacaaggagatatttttacggcacggcggctgaacaattaattacgacaggagtaagaccttatgagcaagacatttgcccgcagcagcctgtgtgcgctcagcatgacaataatgaccgctcacgccgccgaaccgcctaccaatttagataaaccggaagggcgactggatattatcgcctggccgggatacatcgaacgcggacaaactgataaacaatacgactgggtaacgcagttcgaaaaagagacaggctgcgcggtgaatgtgaaaaccgccgcgacttccgatgaaatggtcagtctgatgaccaaagggggttacgatctggttacggcatccggcgatgcctcgctgcgtttgattatgggtaaacgcgtgcagccgattaataccgcattgattcccaactggaaaacgctcgatccgcgcgtggttaaaggcgactggtttaatgttggcggcaaagtttacggcacaccttaccaatgggggccgaacctgctgatgtacaacactaaaaccttcccgacgccgccggatagctggcaagtggtttttgttgagcaaaatctgccggacggcaagagcaataaaggccgcgttcaggcttatgatggccctatctatattgcggacgctgcgttgttcgttaaagccactcagccgcagttgggcatcagcgatccgtatcaactcaccgaagaacagtaccaggcggtgctgaaagtgctgcgcgctcaacacagtttgatccatcgctactggcatgacactaccgtgcaaatgagcgatttcaaaaacgagggtgtggttgcttccagtgcctggccctatcaggccaacgccctgaaagccgaaggccagcctgttgctaccgttttcccgaaggagggtgttaccggttgggctgataccaccatgctgcatagcgaagcgaaacatccggtttgcgcctacaaatggatgaactggtcattaacgccaaaagtgcagggcgatgtggcggcctggtttggctcgttaccggtagtgccggaagggtgtaaagccagtccgttattaggcgaaaaaggttgtgaaaccaacggttttaactatttcgacaaaatcgccttctggaaaacgcctatagcagaagggggcaagtttgttccctacagtcgctggacgcaggattacattgccattatgggcggtcgctaacttcgctggggtgctttatgacgtacgcagtggagtttgacaacgtctcgcggttgtacggtgacgtgcgcgcagtagatggcgtcagtattgcgataaaagatggtgagttcttctctatgctggggccgtccggctccggcaaaaccacctgcctgcgcctgattgctggcttcgaacagctttccggcggggctatctctatctttggtaaacccgccagcaatctgccaccgtgggagcgggacgtgaatactgtctttcaggactacgcgctatttccgcatatgtcgattcttgacaatgtcgcctatgggctgatggtcaaaggcgtgaataaaaagcagcggcacgcaatggcgcaagaggcgctggagaaagtggcgttggggtttgtacatcaacgtaaaccgtcacaactttctggtggtcagcgccagcgggttgctatcgccagagcattggtgaatgaaccgcgcgtattgctgttggatgaaccgctcggcgcactggatctcaaattgcgtgagcagatgcagctggaactgaaaaaactgcaacagtctctcggtatcacttttatcttcgttacccacgatcagggcgaagcgttatcgatgtccgatcgtgtggcggttttcaataatggacgcattgagcaggtcgattccccgcgcgatctctatatgcgcccgcgcacgccgtttgttgccgggttcgttggtacatcgaatgtttttgatggactgatggcagagaaactttgtggcatgacgggaagcttcgccctgcgaccggaacatatccgcctcaacacccctggtgaactgcaggccaatggcacgatccaggcggtgcaatatcagggcgcggcaactcgttttgaactgaaattgaacggcggtgaaaaactgcttgtgagtcaggccaatatgacaggcgaagaactgcctgccacgctcacgcccggacaacaggtgatggtttcctggtcgcgtgatgtgatggtgccgctggttgaggagaggtgaatggcgatgaatgtattgcaatcaccttcacgtccaggtctgggtaaggtgtccggtttcttctggcataatccggggctggggctgtttttactgctgcttggcccgctaatgtggtttggcattgtctatttcggctcgctgctgacactgttatggcagggattttatacttttgacgatttcaccatgtcggtaacgccggaactgacgctggcgaatatccgtgcgctgtttaatccggcgaattacgacatcattctccgcacgctgactatggctgtggcagtcactatcgccagcgccattctggcttttccaatggcgtggtatatggcgcgctataccagcgggaaaatgaaagcgtttttttatattgcggtaatgttgccgatgtgggcgagctacattgttaaagcctatgcctggacgttattgctggcaaaagatggcgtggctcagtggtttttacaacatcttgggctggaaccactgctgactgcgttccttacattacctgcggtgggcggaaatacgctgtcaacttccgggctggggcgctttctggtgtttctctatatctggttgccgttcatgatcctgcccgttcaggcggcgcttgagcgtttgccgccgtcattgttgcaggcgtcggctgatctcggcgcacgtccacgacaaacctttcgctatgtggtgctgccgctggcaatcccgggtattgccgctggctctatctttaccttctcactcacactgggcgattttatcgtcccgcagctggttggtcctccaggatattttatcggcaatatggtttattcccagcagggggcgattggcaatatgccgatggcggcggcattcaccctggtgccgattattctcatcgcactgtacctggcgttcgtgaaacgtctgggagcgttcgatgcactctgaacgcgcaccgtttttcctcaaactggcggcctggggcggcgttgttttcctacattttcccatcctgataatcgccgcctatgcgtttaacactgaagatgcggcgtttagttttccaccgcagggcctgacgctgcgctggtttagcgtggcagcacagcgtagtgatattcttgatgccgtgacactgtcacttaaagtggcggcgctggcgacattaattgcgctggtgttagggacgctggcagctgccgcgctgtggcgacgagactttttcggcaaaaacgccatttcgctgttactgctgctgcccattgcgctgccgggcattgtcactggtctggcgttattaaccgcctttaaaaccatcaatctggagccgggatttttcaccatcgtggtcggtcatgcgactttttgtgtagttgtggtgtttaacaatgtcatcgcccgttttcgccgcacctcctggagtctggttgaggcgtcaatggatcttggggccaatggctggcaaaccttccgctacgtagtgttgccgaatctcagttcggcgttactggcaggaggaatgctggcgtttgccttgtcgttcgatgaaatcatcgttacgacctttacggcaggtcatgaacgaacgttaccgttgtggttgctcaatcagcttgggcgaccgcgtgatgtaccggtaactaacgtggtggcactgctggttatgttggtaacaaccttgccgatcctgggggcctggtggctaacccgcgaaggcgacaatggtcaataaccactgatacaggaatatgctatgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaaggataatattgcagatcgtaagagtatgagatgatcttgcgtactgtcagagcactgatttctctgacagtacgtgctgcgtgcaaaatcactacatcaaataaaccagccaaatctcatagagataagagtaaacaaaccaacagcagcaaagaaatttatcagtactacagttctactggaaacattcatttttgccaccttttatcattgcccctatgtgtatagtacgggttaagaaaatccgcaataatactcattctgaagatggataagggcaagttgctgtttgatgattttttctcaaactggtgaaaaaacttgatgcacgtcaaaaaatgacgcatatttgcgcgcgttttattcatctggctggacgcccgtacatgtctctctatcaacacatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttcactgttttaaatcttactcactggcttgacggcaccacgcagacttatatcatttggatgaatcgataaatttcacaagtggctaaggagaaagtatgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcaacgtctgcgcacagcgatcgcccatcacggtcgcaagcataaagaagatatggaagcgcgccacgaacagttaaccaaaggcggcaccatcctctgattaaaatgagcgtctggctaccaaccaggcgccaaccacaagtaaaattgcgccacaaattgggccgaacaacgcccgtagtggtacgccatgactgcggaagatatccagcatcagaccgccaatcagctgactggcgaccagtacagcaatagttgtcgccgctcccacattctgatatccgctgatactggcgaagacaaaaaacgatcccagcaagccaggtataagtgtccaccagcgcacgctggacaccagttcgccaaaccccgccatgccttgtttaaaccataaaatagaaacaaagagcacaatccccaccagtgagttcagcaacatggcgatgagaatggtagaggaggtctgggtgatgcgcaccatcagcgtgttctggacaaccagaccaattccggcggcaatcaaaaaagcaagggtgagcgactgattcatccaatcgcgtccggttcagtgcgctcgtcgagttgcaactgcataaatgtcagatccagccaacgaccaaatttagtgcctacctgcggcatttgcgcggtgacgacaaatcccagcgactggtggagatgcagcgaggcctgattttgcgattcgatcccggcgaccatgacatgcttcccgcaatcccgcgcttcatcaatcaatcggcttaacaatttacgccccagacctttgccctgatgatcgggatggacataaaccgaatgttccacggtatggcgaaaaccatcgaaactacgccagtcgccaaacgaggcatatcccgtcactacgccgttttcctcgctcaccagcactggataacctgctaaagtccgcgcttcaaaccaggcaatgcggttatcagcatccaccgtttggtcattccagatagccgccgtatacaacacggcgtggttataaatttccgcaatggcagcacagtcggctttgcgggcaaaacggatggacatgtctggcctcaataaaataatgatgatgatgttatcaatactatcgaaaacagcccgaagcaacggattcctcgatgaaattattgcgtgttgcagaggggatgtgacggctgcaaacaaaaccaatcccgtgagcctgctactattgatggattcatgccaaaagcacaggagagcattatggggcaacaaaagcagcgtaatcgacgttgggttctggcctcgcgtccacatggcgcacctgttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggtacggtgagccgtgtcgtggagtcgaatcatcctgattatcagtctggcgactgggtgctgggctacagtggatggcaagactatgacatatccagtggtgatgatctggtgaaacttggcgatcatccgcaaaatccatcgtggtcgctgggtgtgctagggatgccaggctttaccgcttatatgggcctactggatatcggtcagcctaaagagggcgaaacgttggtggtagctgcggcgacaggaccagtgggggcgacggtggggcaaatcggcaaacttaaaggttgcagagtggtgggggtagccggtggcgcggaaaaatgccgccatgctaccgaggtgttaggcttcgatgtttgtcttgatcaccacgcggatgattttgccgaacaactggcgaaagcgtgcccaaaaggtattgatatctattatgaaaacgtgggcggtaaggtattcgatgcggtgctaccgttacttaatacatctgcgcgcattcccgtctgcggattagtgagcagctataacgctacagagctaccacccggtccggatcgtttacctctgttgatggctacagtgctgaaaaaacgtattcgcttgcaaggttttattatcgctcaggattatggtcaccgcatccatgagtttcagagggagatggggcaatgggtgaaagaggataaaatccactaccgcgaagaaattactgacggtttagagaatgcgccacagacgtttatcggcctgctgaagggtaaaaacttcggcaaagtggtgatccgcgtggcgggtgatgattaaagtttcaacggcggcgtaagccgccataaaaatccaggcaaaaagcttattttcagctttaattaactaaccacatcattgttctgctgctaataacaacaaaggtgagtggtttatgattattcactttaatacaccaggtgaattccttctgccatgcaggcagggttggacagaaaacacgcgaaggaattaaaatgcctggaacgggaaaaatgaaacatgtcagtttgactctgcaggttgagaacgacctgaaacatcagcttagtattggcgcattaaaacctggcgcacgcctgattactaaaaatctggcggagcaattaggtatgagtattacacctgtgcgtgaagcattattacgtctggtttcggtgaatgcgctttctgtcgcacctgcacaagcatttacagttccggaagtggggaaacgtcaattagacgaaatcaatcggatccgctacgaactggaattaatggcagttgctctggctgttgaaaacctcaccccgcaagaccttgcggaactccaggaattgctcgagaaattacagcaggcgcaagaaaagggcgacatggaacaaatcattaatgtaaacaggctatttcgcttagcgatttatcatcgctcaaatatgcccatcctgtgtgagatgattgagcaactgtgggtcaggatggggcctggtttacattatctctatgaagcgattaatccagcggaattacgggagcatatagaaaactatcatctgttactcgctgcgttaaaagcaaaagacaaagagggatgcagacattgtcttgctgaaattatgcaacaaaatattgctattttataccagcaatacaatcgttaaagtaaatgcccggcaaataccgggcatcaaggtaattactcaaatctccacgcaatattcatgccgacaccataatttcgtccgggcgaaggttcgtaatatcgcccgtttgactcattgacaatgacagaaccaacgtattctttatcgaataaattatcgacacgaccaaataaatccacagttaaattgtggtaattgtatttatacccggtgaataagccgacgagagtataagacggcgcttttgccgtattttcatcatctgccataatatcgcccatataacgcgcttccgtgcctgcataccaaccatcttccggtacataacctatcgacgcaaagcccatattacgggcgatccctggcatccgattaccgttacaatcctgttcattgcaaacattgctgcgataggtcgcatcaagccaggtccaggacgcgtttacgcgaaaatctcctgcgaaacgttgatcccatgccagttcagcgccttgacgacgggtctttccggcatttttgtaagtcgtacgcccaccgctactgctatcgacaacaatttcatcatcagtgtcggtctgaaacaatgcgagactaagcagcccatcaccaatacgcgttttactgccgatctcaattgtatcgttggtggatggttttaaacctaagttcataccgctttgcccatcagcacgataagacagctcattaatcgtcggcgtttcaaaacctcgcccggctgccagatagatattccaggcatcggtcattgcatattttaacgaaccggcaggtagccatttatgataactggcatcaccgctgtcatcgccgttacccggagtaacgtaatggtcgttggaatcaaaccacacggagctgtagcgcacgccagcatccagcgacagtttttcgctcagctgccactgcgtctgtaaatagggatcgatgttccacatcagattgcgttcgtcgcgacgcaactcacctttttgcccgtactccggcatgccgctattcaggcggaagttattgtagcccttgcggttttcactcatgttttcgtagttcaggccggtagtgaacgtgaccggaacgcccagttcaccacggtgtgtccagcggctgtctattccctggtaatggcgttgcagggtaatcacgccgcccgcatgtgacgggttaagttgtggtgccatgggtattgactggtactgggtcgtttctcgctctccggcatacatcatcacactcatatcatcccgcgaactcaggctacgctcatagcgcaacccagcctgagtttgcttgatggtttttcgcgtgtcgtactgttctgcacgaggcgcttgttgtggattagccttccattctgctttggttagcccacctgggtcatctgctttgatatccacactattgaaaatcagacttaatttgctggcttcatcaatgcgtacgcccagtttggcattggctaaatttttctgtgcgccactatggtcacgatagccgtgggtcgtaaaacgcgtggttgagacggtgtaatcgacatcgccaggctgtgtgccgtctcccgttgcgcccgttgctttcagcccatagcgccagctgccaaaactgccgtagtaactactggcttcaatggttggtggctgttgtccggtctgggtggtgacattcattaccccaccagacgcgttgccatacagggcagagaaggggccacgcagcacttccacattttgcacactgcttaaatcgatgttggatgtttgcccttgcccgtcgggcatggtggcgggaataccgtccacatacaggcgaataccgcgaataccgtaagtggagcgggagccaaatccgcgaatcgacagctgtaaatcttgcgcatagttctgccggttttgtacctgcaaaccaggcacgccggtcagtgattcggacaagttaatgcgcggtgttgccaggcgcatctcctcgccatccaccacgcttactgctgctggggtatccagttctgaaaccacctgcggtgcggcactgacaatcatagtctgttcatcagcggcaaaaacaacgggggaaaggacaagcagtgcgggcaaaacggtctgtcggacggaaaaaatcttcatgaaaaaagccaggttaagaatgggaaaacgccgtcatggtaatgaaattgtaaatttatggaaaatgaaacggcacaatacgttaagtaattgagaaaattgtagtcgtaacggcaagaaatgctccacatttgagaaaataatgattaccattcccatttataacaagagcgtaacgatgattacgcttagcgaagcattgtgaagcagcaaaaatatcggttcatcaaagggagtcgtcatgcatttacgtcatctgttttcatcgcgcctgcgtggttcattactgttaggttcattgcttgttgtttcatcattcagtacgcaggccgcagaagaaatgctgcgtaaagcggtaggtaaaggtgcctacgaaatggcttatagccagcaagaaaacgcgctgtggctcgccacttcgcaaagccgcaaactggataaaggtggcgtggtttatcgtcttgatccggtcactctggaagtgacgcaggcgatccataacgatctcaagccgtttggtgccaccatcaataacacgactcagacgttgtggtttggtaacaccgtaaacagcgcggtcacggcgatagatgccaaaacgggcgaagtgaaaggccgtctggtgctggatgatcgtaagcgcacggaagaggtgcgcccgctgcaaccgcgtgagctggtagctgacgatgccacgaacaccgtttacatcagtggtattggtaaagagagcgtgatttgggtcgttgatggcgggaatatcaaactgaaaaccgccatccagaacaccggtaaaatgagtaccggtctggcgctggatagcgaaggcaaacgtctttacaccactaacgctgacggcgaattgattaccatcgacaccgccgacaataaaatcctcagccgtaaaaagctgctggatgacggcaaagagcacttctttatcaacattagccttgataccgccaggcagcgtgcatttatcaccgattctaaagccgcagaagtgttagtggtcgatacccgtaatggcaatattctggcgaaggttgcggcaccggaatcactggctgtgctgtttaaccccgcgcgtaatgaagcctacgtaacgcatcgtcaggcaggtaaagtcagtgtgattgacgcgaaaagctataaagtggtgaaaacgttcgatacgccgactcatccaaacagcctggcgctgtctgccgatggcaaaacgctgtatgtcagtgtgaaacaaaaatccactaaacagcaggaagctacccagccagacgatgtgattcgtattgcgctgtaatagatatggcgagggtgaaaacggtgagacttgcctgccttttatcacggcgtatccggcactttcgtcagtaatctgaatttgcccggcacgtagccgggcaattttgcaattaactcgccgtttcaggcttaaacacaatttcctgtttttcttcatcttcctcgacgactggcgcagtgctgtgaatttcagcaacgcgtttgcgcacaccaaaccagcctataaccagcaaaataccgataatcggcagcgccgcgatagtataagtcccgttcgggtaatcgaacgccatcagcacaaggacactcagtaaaaacagtaatgtcagccaggaagtgaagggcgcgccaggcagtttaaaactgacatccgctgctttgccttctttaatcgctttacgcaggcgcatctggcacacgatgataaacgcccatgaagcgatgattcccagcgacgcgaagttcaacacaatctcaaatacgcgcgacggcaccagatagttgaggaatacgccgacgacatacacaactagtgtcgccagaatcccggcatacggcacatgctgacgactcattttcgccataaaactcggtgcggaaccgcccatcgccattgagcgcagaatacgtccggtgcagtacagacctgaattcaggctggagagggcagcggtcagcaccacaatgttcataatgctgccgatatatggcacacccagtttagagaaaaacgtcacgaacggactttgccccgcctgatacgcgctccacggcaataacataaccagcaacaccacggagccgacgtaaaacaggccaatacgccaaatcacactgttaatggctttaggcaccatggtctgcggatctttacattctccggcagctgtacccaccatttcaatggaggcaaaagcaaacactacgccctgaatcaacaccagcgcaggcagcaaaccgtgggggaagaagccgccattatcggtgattaaatgaaagccagtggtgttgccatccagcggctgaccactaccgaggaacactgtacccacgaccaaaaaggtcacaatggcgagcactttaataagcgcaaaccagaactccatctccgcaaaccatttcacaccgatcatattcatggtgccaacgatggtaagtgcagcgagcgcaaagacccactgcggcacgccgccaaacgcaccccagtaatgcatatacagagcgacggcggtaatatcaacaatccccgtcatcgcccagttgatgaagtacatccagccagcaacataagcggctttctcacccaaaaactcacgggcataagaaacaaaactgccactggaagggcggtgtagcaccagctcacccaatgcacgcagaataaaaaacgaaaacaagccacaaattaaataaaccagtgccagtgcgggccccgccatttgcagtcgggctcctgcacctaaaaacaagccggtgccaatcgcgccgccaatggcgatcatctgcacctggcgattgcccatcgctttgtgatacccctcttcgtgggcattaagccagcggcgtttcgcggcgtgttgatctgaagtgtcggtgtcgtgtttactcattgctctccctgattgctttaatgaaaaagtcatataagttgccatgaacaatgtttattcatcctggcgatgatagttatcaccattattctttatgggtataaaactatcggcgcagcatcctacccgttatcgataaacgatgcaaaacatccccttacaatcctgaaggggattaatacaactgacgaaaaaatgacaaatccttttgctggttaacctgtgtactgtcctacacttaatctttaaaagattgtgaggggcatatgattaaggtgtatggcgtacccggatggggctctacaatcagtgagctgatgctaacactggctgatattccttatcagttcgttgatgtcagtggttttgaccacgagggagcttcacgcgagttattgaaaaccctgaacccgttgtgtcaggttccgacactggcattggaaaatgacgagattatgacggagacagcggcgattgcattgatggttctcgatcgtcgcccggaccttgcgccaccggttgggcgcgccgaacgtcagctgtttcaacggctattggtctggctggttgctaatgtctatccaacattcactttcgccgattaccctgagcgttgggctcctgacgcacctgaacagttaaagaagaatgttattgaatatcgaaaatcgctttatatctggttgaattcgcagctcactgctgaaccttatgcgtttggtgagcaactaacgctggtggactgttatctttgcactatgcgcacatgggggcctgggcatgaatggtttcaggataatgccacgaatatcagtgcgattgctgatgctgtatgtcagttaccgaaattacaagaagtattaaaaaggaatgaaattatttgagtgggataccagaagattatgttatttattattcagtaactttatccacaatgatgggcgtaattaattaaattcatggtatgttttttaatttatatcactctccttttcattcagcgtgtctatttcatttcctctgaaaagaaactaactattcacatcgtgcagatgtttcagttgttatcacaggcattctataatctcaaaatgtttttaatgatggatatgctcggagttggagatgcaattaatattaatacaaataaaaatatccggcaggtatgctaaaaggataaatggcgttctctgtatttattcgcaattatctgtaggacaaatatggagagcttgatgagtcagagctaaaacagcaattgattaataaacatgttgatttattcaagaaaatggatgtattttaaatgttgattcttaatataacctaatcaatagattatcaagtgagagctacacattattggaggggcaggggaaaacaccattttgggaacaatgcatcaggtactcttaccactgaagcaagatcatccggcaccaggtggtggtgcagtgctttggaaatggtcccctcgggggagttgtcattattttctatgctatttgcttattatattcatcaggtgaatttaataaattcctaatttgaaatatccactattaagctagtgtttaacgacgttaagatggcaatgtgcagatcatgttatcagggtggggcggtagcgtatattccttatacaaaccatcattcatttcaatgattgttattgaattatttattgttgtgaataaaaagacattatgaatattggtttgactttgcatatcaggttttttattactcgctgtaatgtacgagcctgtcgtgaataacgtcgagaacccatccgttgcgtttgtgattattttgttgactaaacagacacccgtttctctgaagtaaaatcccagactaaatcatcacataaccatgacatttttctgatattccccggtaacgccagatgtcgactcgcttaaccaccctcagccataccagtgaaggccaccgcgtgtcggtccactacggctatgacgataaaggccgcctgaccggcgaacgccagacggtggagaacccggagacgggggaactgctgtggcaccatgagaccggacatgcgtacaacgaacaggggctggcaaaccgcgtcacgccggacagtctgccgccggtggagtggctgacctacggcagcggctatcttgcgggcatgaagctgggcgggacgccgctgctggagttcacgcgcgaccgcctgcaccgtgagacggtgcgcagcttcggcagcatggcaggcagtaatgccgcatataaactgaccagcacatacacccccgcaggccagttacagagccagcacctgaacagcctggtgtatgaccgtgactacgggtggaatgacaacggcgacctggtgcgcatcagcggcccgcgacagacgcgggaatacggctacagcgccacgggcaggctggagagtgtgcgcaccctcgcaccagacctggacatccgcatcccgtatgccacggacccggcgggcaaccggctgccggacccggagctgcacccggacagtacactcacagtgtggccggataaccgcatcgcggaggatgcgcactatgtctaccgccacgatgaatacggcaggctgacggagaagacggaccgcatcccggcgggtgtgatacggacggacgacgagcggacccaccactaccactacgacagccagcaccgcctggtgttctacacgcggatacagcatggcgagccactggtcgagagccgctacctctacgacccgctgggacggcgaatggcaaaacgggtctggcggcgggagcgtgacctgacggggtggatgtcgctgtcgcgtaaaccggaggtgacgtggtatggctgggacggagacaggctgacgacggtgcagactgacaccacacgtatccagacggtatacgagccgggaagcttcacgccgctcatccgggtcgagacagagaacggcgagcgggaaaaagcgcagcggcgcagcctggcagagacgctccagcaggaagggagtgagaacggccacggcgtggtgttcccggctgaactggtgcggctgctggacaggctggaggaagaaatccgggcagaccgcgtgagcagtgaaagccgggcgtggcttgcgcagtgcgggctgacggtggagcaactggccagacaggtggagccggaatacacaccggcgcgaaaagttcatttttaccactgcgaccaccggggcctgccgctggcgctcatcagcgaagacggcaatacggcgtggcgcggggagtatgatgaatggggcaaccagcttaatgaggagaacccgcatcacctgcaccagccgtaccgtctgccagggcagcagcatgatgaggagtcggggctgtactataaccgtcaccggcactacgatccgttgcaggggcggtatatcaccccggacccgattgggttgagaggtggatggaatatgtatcagtatccgttgaatcccatacaagtgatagacccaatggggttagatgcgattgagaatatgacatcaggtggactaatttatgccgtatctggtgtacctggattgattgctgcaaacagcattactaacagtgcttaccagttcggttatgatatggatgctattgttggcggagctcataatggggccgccgatgcaatgagacattgttacttgatgtgtcgaatgactaagacatttggatcaacaatagctgacgtgataggtaaaaatcatgaggcggcaggggatagacaaggtcagccagctaaagaaagaatcatggatcttaaaaataacactgtcggtattgcttgtggcgatttttctgccaaatgtagcgatgcatgtattgaaaaatataacactgggcaactcttcgggttagatggtataaaagcagataatccaataaaagcaaagcaagggagttcagatgcttcaaattattagaggcaaacttgtcatttttttaattaccctttgtttatttgttgtttaccttgggtttgataacaattcaaattctgacatcgtattttatggacataaaacaccaaagagcgttgagatatatctttctgaaaaaaatattatttataaaataattaatgaccaaaaaattagtagagggaatggtcattttataagtataatggttaataattacaggacgcactgtggagtggttgatataaatcttaattttttcaatgatattctttatagcgtgcgattaaaaaacattagtaaactggagaatatggagttctgcgctacaaaacaacgggtgtattttagtgataaaaacaagaaggctagttataaaataattaattatggagactattatgatgttgattattatgataacaatttgaaaaatgaagtttttgactggattggtaaatggtcataatgaacaacaccagaaagagaaaaatataaaatacatacagaaagacatgagagcaagggacggggcagggcaagatcatgaaaattgtgatgtaaatcacgattttcatctttgctttaacgcctacaggtgatcaaaatttaacctttggaataactaaaaagataaaaaaggacgccaggtgagtattcaaagtttgcttgattatatttcagtgacccctgatatacgacaacaaggaaaggttaaacataaattatctgctattttgtttctcaccgtatgtgcagtaattgcaggtgccgatgagtggcaggaaattgaagattttggacatgaaagacttgaatggctaaagaaatatggtgattttgataatggcattccggtcgatgacaccattgcacgcgttgtgagtaacattgacagtttggcctttgaaaagatgtttattgaatggatgcaggagtgccatgaaatcactgatggtgaaattatagcaatagatggaaagaccataagaggctcctttgataagggaaaaagaaaaggagcaatccatatggtgagtgcattctcgaacgaaaatggtgttgtactggggcaggtgaaaacggaagccaaaagtaatgagattacagccattccagagttgcttaacctactgtatttaaagaaaaatttgataaccattgatgctatgggctgtcagaaagatatcgcttcgaagatcaaagataaaaaagcagattatcttctggcagtaaaaggcaatcaggggaaattacatcatgcattcgaggaaaaatttcctgtaaatgtgttttctaattataaaggcgattcgtttagtacgcaggagataagtcatggaagaaaagaaacacgtttgcatattgtcagtaacgtaacgcctgaacttttgtgattttgaattcgaatggaagggattaaaaaagctttgtgtagcattgtcattcaggcagaagaaagaagataaatcagcagaaggtgtaagcatccgatattatatttcatcaaaggatatggatgctaaagaatttgcacatgctatcagagcgcactggctgatcgagcacagtcttcattgggtgttagatgtaaaaatgaatgaagatgccagccggataagaagaggaaacgcagcctaaataatatctggaataaagaagatggcactgaatttattaagagattgcaaagacattaagggtgaagaggaaaagaaagaaggctgcgttaaacacagggaaagatcatcagaagttcactttttgtactaaacaattcgcattttatgtttaaaaattgagatattccttattacctaaagctgttttttattgcttacacatgatcaaatactccttacataattaaggagaacaaaatggaacttaaaaaattgatgggacatatttctattatccccgattacagacaagcctggaaaatggaacataagttatcggatattctactgttgactatttgtgccgttatttctggtgcagaaggctgggaagatatagaggattttggggaaacacatcccgattttttgaagcaatatggtgattttgaaaatggtattcctgttcacgacaccattgccagagttgtatcctgtatcagtcctgcaaaatttcacgagtgctttattaactggatgcgtgactgccattcttcagatgataaagacgtcattgcaattgatggaaaaacgctccggcattcttatgataagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaaaccaggggcggctaaataaagcctttgaggaaaaatttccgctgaaagaattaaataatccagcgcatgacagttacgcaatgagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagctcgaaatgacggtcagatattatatcagttctgctgatttaaccgcagagaagttcgccacagcaatccgaaaccactggcatgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactacctggcgtcagtccttacggggagcgggctttcgtaatcttgccctgggcattattgtcgtataaacgctttaccggacacatgacattcacaatgtgtgttaattttactgacatctttcaaaaggagcgtaatcatgccgcacatcgacattaaatgttttccgcgtgaactggacgaacaacaaaaagcagcacttgctgcagatattaccgacgttattattcgtcatctgaacagtaaagacagttcgataagcattgctctacagcagattcaaccagaatcttggcaagctatctgggatgccgaaatcgcgccccaaatggaggctttgataaagaaacctggttatagcatgaatgcttaacccgccgtaacacgcttgccgctggtaacaaacgtcccagcacctaaatgatgcaacgtattgagcttatcatcatcaaactgccagcggccttcgacaaatacccgtgcgtctgccgctgctgatactacttcgccaaacagcgtgtcgtattcttcttgcgcagaagtcgcaggtagcaatcgacactccatccacgccagacatttttcctcgaccagaggcaaaccaaataccgggcctctcacaaccggaatgccatagcaattaaatttatcttcatcacgccccgacacacttcccaccgcccacgtccagttagttgctgcaacgcccgggataacgatgccaaatttaccgttatgttcaatcaactccctggtccatgtcgatttatctaccacaatcgccacgcgtggaggttcaaactccaccggcattgaccaggctgcagccataatgttacgccgctgggattgctcatcgaaactggtgatcaagaccgttgggccatgatttaacagacggctggcatggtgtaattctatggggatgaatcggctcatggtatcgcctcgcgaagaaggtttttttaagcgtagtccgtaacgcaataagtaacgaaattaacgggattggcgatttgcgaacgtgatgcatgtccgcgatcgcacaaaatagccggtgcggcgtctattccaggttataagttgagaaaaccactaagggaaacgcctgatgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataatttatgtcaggttgccggatgcggcgtaaacgccttatccggcatacattagcccggttgtagacctgacaggcgaagcgcatcagacaacggtttcagagttcaattgcccattcggcatgaaacaaaatcaccgctgtgcctgaaatggtgactttttccggttggttatcacgaattgtcaccgtcacttcaatcataccgtcacgccccaatgcgcgcccctgatggcctttaacacgcaacacgttgccatcgtggggcaatacgttgtgatgtaccaaccatgcacccatcgggccattggcattgccagtcaccggatcttccacaataccaatcgcaggcgagaacatgcgaccatcggtttcgtttttgcctgggcggatctggaacgggaagaaaccattgcagccaatctttttgctgatagcggtcagcgcattaaggtcaggcgaaagggcgtcgatatccacttccggtttcagtgggatcatcacttttgagtgtcctgttgttgccacctgaattggcaagcctggcagaatatcgtcctcagtgagatgaagcgcgttgataatcgccgcacgtgtttcaccttccagcggtggctcaaagcccggcgtaccttgttccagcgaaatacgataatcatcgttgtgcttttcgatagtcacgcgatgttttcctgccagcgatgtttgccagatcgtgcaatttcctaaacctaacaccttcgcacgtacatagtgcgcagctactgtcgcgtgaccgcaaatcggcacttcaaccgttggcgtaaagtagcggatgcgcacatcgctgtcgtcgctgtgcagcagaaaagcagtttccgaatggcctaactcgcgggcgataagctgcatttgcgcttcgctaagattatcggcggggaaaacaacaccggcagaattgccgcgaaacggttgtgaggtaaaagcatcgacgtggtacacctgcggtttcattaacgttctcctgtgactggagaactatcatagcctgcaagtggccggagagcgaagggctatccggccagggtgaaattatcgccgcgaacgcacaatttgatatcgacgagtaaagtactcaaacggcgcgctccacacatgcaccagtcgggtgaacgggaagagcaggaagatggtcattcccaacaccagatgcaggcggaagacgaacgctacgccgttgagcatctctgacgatccaccacggaaagtgacaatgctttgcgcccaacccaccagcttcatcatttcgctaccatcaggatactgtgctgaaaacggtatggtacttagccccaacagacactggatcagcaaaatgctcatgatgatgatatccggcgtagtggaagtggcacgcacgcgctgatttgtcagcctgcgccacagcagtcctgcgccgccaatcaacgtcaacacaccgcaaataccgccgagcaccatcgccatgagttgtttcgctgccactggcaaaaaccacgcgtacatccagtgcggcgttaacatgccgaacaagtgcccgaagaaaatccccaaaatgccgatatggaacagattcgaccatatcaccatcccgcgtttatcgagcatttgacttgaggaggcgcgccaggtgtactgcccgtagtcgtagcgcagccagctgccgaggaaaaacaccgtcgcacaaatgtacgggtagatatcgtaaaaaaagacgttcagatactgaatcatttcccacctcccgcactgatgtcgacatattgcggcgcgacatcctggctaaagcgtcgctgatattgattaagcggcgagctgtcacacgccgtggcgttatcttcaataaacttcacctgttcctcttcccacactgcatcaagcgcctggcgggtgtcatcgcgctcttcgctgtttacttgttttgtgacactgtcacttgaaagggagcttcccgccagttgcagcagagcatcaaacaacgcgtaccacggtgcctcgcgttgttttaagcgaccgccaagcagggcgaggatcggcgcaacattgagcaatccttctttcgcctgatcgtcaggcagtacgcttaaatactccagatacagcggtagataatcgggcagttcccgacaatccagctgcaggccgaccttttcatactccgccagcaggtccaccattgcctggccgcgatcgcgggactcggcatgaacatgttcgaacagcagcagcgacgtggtgcgcccgcggtcaaacacttcgcaccattcggcctgtttatccagcagcggcgcgttaagcaggttgtgggtgaaatccgtaagcatcggcgcgtcgcggcggatcaacgccagcgcgtcctccttgcattcccacaacagctcgtccggatactccatcaacaggccgatcactttgaggatctgcattattcgccctccgctttgtcgcgcacttcggtgatgttgatggcatcgatacggctactgttgaacaggttgaatttactgtccgaaccgtggcaaccgtcgccaaaggtaaaaccgcagccgttgcgttctgcgaaggcatcgcccgccatttcccgatggctggtcgggataacaaaacgatcttcatagttggcaatggcgagatagcgatacatctcttcgacctgggcgacgctcaggcctacttcgtcgatggcacgagtatcagtaacgccttccacggtttgtgaacgcatatagtggcgcatcgccatcatccgtttcagcgcccgcagtaccggaccggtatcgccggcactcaacatattggcgagatattgcaccggaatacgcaggctttcgatggcgggcagcacgccttcgcttttcggcaaaccgcccgcatctgcgtaggactgaatcggtgacagcggaggaacgtaccagaccatcggcagggtgcggtattcagggtgcaacggtagtgccagtttccagtccatcgccattttgtagactggcgaacgctgggcagcgtcaatcacattttgtggaataccttgtttcagggcttcctcgatcactgagggatcgtgtggatcgaggaacacttcgcactggcgttcatagaggtcaacttcgcgctcggtgctcgccgcttcctcgatgcggtcggcgtcgtaaagcagcacgcccagataccggatgcgacccacgcaggtttctgagcacacggtcggttgaccggactcaattcgtgggtaacagaagatgcatttttctgacttgccgcttttccagttgaagtagatttttttgtacggacaaccgcttatgcacaaacgccagccacggcatttatcctgatcaatcagcacaatgccgtcttcttcgcgtttgtagatagcgccgcttgggcaggtcgccacgcagctgggattgaggcagtgttcgcacaggcgcggcaggtacatcatgaaggtgttttcaaactgcccgtacatctccttttgcatggcctcgaagttgcggtcgcgggcacgtttttcgaactcaccgcccagcagttcttcccagtttggcccccagatcactttgtccatccgtttgccgtcaatcagtgaacgcgggcgagcagtaggaatatgtttgccttccggtgcgctatgcaaatgttcgtagtcgaaggtgaaaggttcgtagtaatcatcaatctgcggcaccaccgggttggcgaagattttggttattacgcccatcttgttgcccagacgcgggcgtatcttgccattcacatcacgcacccagccgccttgccactcttcctgatcttcccagtttttcggataaccaatgcccggtttggtttcgacgttgttaaaccatgcgtactccatgccttcgcgcccggtccagacgtttttacaggtcaccgaacaggtatggcagccgatacatttgtcgaggttaagcaccatgccgacttgtgaacggattttcattttttcgcctcctgtacctgatcgcgaccttcatcatccagccagttaacgttcttcatcttgcggatcatgatgaactcatcgcggttcgatccgacggtgccgtagtagttaaagccccaggccagctgcgcgtaaccgccaatcatatgcgttggtttcgggcaaacgcgggtaaccgagttatgaatgccgccgcgcatgccagttacttccgaaccaggaatattcataatgcgttcctgggcgtgatacatcatggtcatgcccggcggtacacgttggctgaccaccgcgcgggcagtcagcgcgccgttggcgttgaatacttccacccagtcgttatcgacaatggtcagttctcgggcatctgtttcgctgatccagacaatcggtccaccgcgagagagcgtcagcattagcaggttttcactgtaggttgagtgaatgccccatttctggtgcggcgtcaggaagttaagtgctttttccgggaagccgtttggcggtatctggcgcatctcactgacgctacgggtgtcgataggcgggcgataagccaccaggctttcaccaaaagcacgcatccacggatgatcctgatagagctgctggcgtcccgacagcgtgcgccacggaattaactcatgaacgttggtgtatcccgcgttataggagacgtgatcgctttccagaccggaccaggtggggctggagataattttacgcggctgcgcctgaatatcgcgaaagcgaatcttctcgtcctctttgtgcagcgccagatgggtatgttcgcgcccggtgatctcgcccagcgcctgccacgctttgactgcaacatgaccgttggtttccggtgccagtgccagaatcacttctgaagcgtcaatggcggtgtcaatcagcggacgcccctgtgccgggccatcacgcttggtgtaattgagtttgccgaggaaatcgatttcatcctgggtattccacgaaatccctttaccgccattgccaagtttgtccatcaatggcccgagcgaggtaaagcgttcatacgtagcagggtagtcgcgctccaccgccacaatattcggcgcggttttgcctggaatcagatcgcattcgcctttgcgccagtcgagcacttcacacggctgtgagagctctgccggagagtcatgcagtaggggttgtaataccacgtcggtttctttgccaagatgacccacgcacacttgcgaaaatgctttggcgatacctttgtagatttcccagtcgctgcgtgattcccacgccggatcgaccgccgcagaaagcggatgaataaacggatgcatatccgaggtgttcatatcgtctttttcgtaccaggtggcggtgggcagaacgatatcggagaacaggcaggtactggacatgcggaagtcgagcgtcaccagcaggtcgagcttgccttcaatcgctgcagtttgccactcgacttcttccggtttgatcccgtcgctggcaccgagttcctcgccctgaatcccgctttcggtccccagcagatacttctgcatatactcgtggcctttgccggaggagccaagcaggttagagcgccagacaaacaaattacgcggatgattgctgctgctatctggttgttcgcaggccatacgtaaatcgcccgatttcagcgcctgggcggtaaattctgtgggggataatccggccttgtcggcttcagctttaatcccgagcgggttacgccccagctgcggcgcagaaggtagccagcccatacgttcggcgcgaacgttgaaatcaatcagatgaccgctgtacttactggcatcggcgagcggtgaaagtaactcctgagcagagactttttcatagcgccattggctggaatgattgtagaaaaacgaggtgctgttcatttggcgcggtggtcggttccagtcgagcgcaaaggccagtggcaaccagccggtttgtgggcgcagtttttcctggccgacatagtgtgcccagccgccaccgctttgcccgacacaaccgcagaagatcagcatattgatcatcccgcggtagttcatgtccatgtgataccagtggttaacacctgcgccgaggataatcatcgagcgcccatgcgttttatgggcggtatcggcaaattcacgggcgatggtttcaatatactggcgcggcacgccggtaatttgctcaccccaggctggggtgtacggtttgatttcagcgtaatctttcgcactgttttcatcttccagcccgcgatcgaggccgtaattcgccagtaccaaatcataaacgctgaccaccggacaggtgttgccatcgactaacgtcaggtttttaacgggcaattggcgcaccagcaccggattgtgttttacgctgcgaaaatgcggattttcaatgccgccaaagtaggggaaggccacgcctgcaacagcgtcatgttgaccgagcagggttaacgacaattcggtttccgtaccggcggcaatggattccagattccatttgcctttttctccccagcggaaaccaatcgaaccgttcggcactaccaattcacctgcggtattaactgctacggttttccactgcggattgttgctttcgcccagtccatccaccaggtcagatgcgcggatcatgcgcccgggaacgtagctaccatcgtcgcgaggctccagcattaccagcatcggcatgtcgctgtagcggcggcagtagttgataaagtagtcgctgggattatcgagatgaaactcttttaaaatcacatggcccattgccatcgccagggcgctatcagtgccttgtttcggtgccagccactggtcgcacaatttggccacttcagagtagtcaggggtaatggcgatggttttagtgcctttgtagcgtacttcggtaaagaagtgggcgtccggcgtacgtgtctgcggtacgttagacccccaggcgatgatgtagctggagttataccagtcggcagattccggtacgtcggtttgctcgccccaggtcatcggcgaggcgggcggcaggtcgcaataccagtcgtagaaacttaaacaggtgccgccaagcagcgacagataacgcgttccggcggcgtaagaaaccatcgacatcgccgggatcggcgagaaaccggcaacgcgatccgggccgtaggttttgatggtccagacgttagcggcggcaatcagctggtttagttcctgccagttggagcggataaacccgccgcgcccacgcacttgtttgtagctcaggcacttttgcggatcgttcataatcgatgcccacgccagtaccggatcgctgtgttgcttgagggcttcgcgccacagttcaatcagtcgtttacgaatgagcgggtatttcaggcggttagcgctgtaaagataccaggagtaacttgcgccacgcgggcagccgcgaggttcatgattgggcaggtcagggcgagtgcgcgggtagtcggtctgttggatttcccaggtcaccagaccatttttaacgtagattttccagctacaggagcctgtacagttaacaccgtgggtggaacgcacgattttgtcgaactgccaacgctggcgatagctgtcctcccagtcgcggttgctatgcatcacctgtccgtgaccatcggcaaaggtttcgcccttttgtttgaagtagcgaaagcgatccaaaagtttactcatgacatgactcctgctccaggaatgaattgggatctgatgccttgtcggatgcgacacggttgtacatcaggcatcgatctcttatttttggctgaacttccgccgaccataaaccagccaggtcagcagcacacaaacgatgtagaagattaaaaacactttcatcgcgccgaccggagagccggtcatattgagcgacatgccaaacgcctgcggaataaaaaagccgcccactgcgccaatggctgagataaagcccagagccgccgccgtttcggtgacggcttctttatgagcttgctcatcactaccgcctttcatctttacccgataaatggttatctggcgaaagatgacggcgatcatctggaaagtagaaccacttcccagacccgcagtcagaaacagccccataaatacggcgtaaaaggcgatgaaattaccggagcctgtgcccggtaaggtaaggaacagcagggcactgaaaatcgccataaaaataaagttgatcaacgtcacccgcacgccgccgaacttatcggaaatagcaccaccaaccgaccgcgcgatggcaccgataaatgggccaaagaacgccaggcgcagaatattcacatccgggaactgggtttttgccagcatggcaaaacccgcagaaaaaccgataaacgaaccgaaggtggcaaggtaaagcaggctcagcagccagagatgcaggcgttgtaagacagggagctggtcggcaattgaggcgcgtgaactggcgatatcattcatccctgaccatgcggcgatcgtggcaatcgccagtagcggtacccaaatccatgcggcattcgccagcgacatcaccgaaccgtcggcctgcggtacgccattgacgccgagaaaggcaaatacaggtacaaaaatgaccagcggtgcaaccagctgcattacacttacacctaagtttcctaatccgccattaatcccaagagcgctcccttgtttggcttttggaaagaagaaactgatattgcccatgctcgaagcaaagtttgcacctgcaaaaccgcatagcaaagcgataacgataaatatcccaaaaggagtattcggattttgcacggcaattccgagccagacgcaaggaataatcaggattgcagtactaaaaaccgtccatcggcgtccaccgaatataggcaccataaaggagtagggaacacgcaataatgcgccagaaacggagggtaatgcggttaataaaaagagttgatcggtagtaaaattaaaaccgattttattgagattaacggtaactgcgctaaatagcatccagacacagaaggcaagaagtagacaactgactgatatccagagatttcttcgagcaatatgttttcctttattttcccagaaggccggattttctggtttccagtcgcgcaaaagataacgactatttttctcattttgcagtgccatattgttcctcacatgcacacattggtaatgaaaaaaagacaaaacacgaggtaaggcgcaatagccagttattagaattaaggatgaattgggtgaagtgctgattgaaagaatagataagaaagcgtaaccgcgggggcagaatggggattaagtagccagatatgtgttactaaatgtaactaacaagctaaccttcaaacggggttaatctttgaacgtatgtcatgtttcaacccttcagatcgtgaatctaaagggttacatattaactatattatcaacaagaccagacacttatagaattagtgatgatttattcactaaaaaggccatgaactggaggaaaacgatctgtccagaaggtctatcggttcctctcttattgcctgattgtaataatcgttattacagtaagtattgtttatttcatctaaggtcatgtttttaacttttatattcatctggtttacaacttcctctgtcttgtaagtgtgtatattatatggggtatatgcttttttaataggatagtgaaacaattcgttatccacatctattccgtcagagtgaacttcaaatgcaccaggcgaaagaattgccaggccagtattaagcttaagtgctggggaaaacaaattaaataacatgagctgcatagtagggcaattgttcttcccagaaacatttaaaaaatttaagttttgctctgttttattatggggaataaagttccaatatcggatgtattattagtatcaatgtgggttattttattattgtccagtcttaaacttttgatagatggaagataagtcaggaaatcaagatttatatatttcaactggttgttagcagcgtttaatgtctgaacattgcagaagttgctatagaatattttaatttcagaaagcaaattgttgttaataagtaacgtattcaagttgggaaataagtcattgtgtaaacttgttagtttattatgggatagatccagcagtaagagttcatttttattacctgcaacaatatcagttaattgattatggctgagattcaggtattgcagccattcgcaagattctaattgcacaaactctagttgattatgtgccgcactaaaataagtaactgatgaaagcctatctatatcaatatttctgagagcattattattcatagatatatgtgtaatacttacatttctgccttgaggaaaatttattgactcaagagcattactattcagacttagctttacgagtctatcgtagttggttgcatcaaaatgtgtgaattggttattatcaagattgatagatgtgaagttttgcagccctggtggttgagtggttaaattaagtcctgataaatcaatggtcacttcattagtgtcatcaattatatttcttactgcagtccagtactgcatttgtgcaagtggatcattgttgatgccgttaactaatacatgccaaagatgttttgatgatattagttgatcaatgtcattggttggcagtaaattgttattgcttaagtttaaatattccagttttgtagtgtttttggcgtttaaatgtgcaatatggttgtcgtttaaagtgattgttttcatcctgggatgattgtgtaatataaggtcagtgatcatattgtgatgggcacttaactcaatcagagattcttgccgcgcgagccgttggcttcatcgttatagcctttaaaatcatattcccagtgaccaaaaccaatcatttgatcattgatttgcgtttctcctttaaagccgagacgggcataagttttatcaccatcgtcacgcttatcatcagtaaaataacgtagagcggtaaccttgccataaaggtcgagtttattaccatccttgttatagacttcggcagcgtgtgctacgttcgcagctaacaaaccagttacaaccaccgcaactatttttaatttcatttaacagaatccttttaattatcgttaaacgtattttctaaacgaattttaaacggcgtcatttataaatgacatactgtttttaaaatagaatggtgattaaaaacaatgagaaaaatagatgaaataatattatttatcgatatgtgatcgaagtcgaaatgagatataaggtgaattactggtatttgaaatttatttttttaatattgtcggaatttatctgattaactaccgggccgtagacccggcagttattttaaccacgacgtgtcgccagccagcagagcagggaaccgccgcagaccatcagcgcgccttgccagaacgagaacgacagcggggcgctgagcagcacggctgcaagcgctgaggaaagtacaggcgtaaaatacgaacctaccgccataatggtgacattgccatgcaatataccgacattccatgcagcataagcaaatcctaaggtaaatgccgcagagatgagtttaatcatgacgggcgtgctaaatatcatttctggttgtggcgtaagaaaatagtaaacccacagacttgctcccgttagcaggacaaaaacggtaattccattaaatccgcgtgcgtatttattcgttactgtgcaataggctgcccagataaacgcaccaatgaacgccaggaaataactcaatgggctggtggtgatattattgatgatttcatcataatgtaacccattgtcaccgcctaacacccaacagacgccgacgagggctaataataatccaggtacaatcaaccagttggttttctgaccattaaacagaatggcaaagagaattgtcaggctgggccacagatagttcaccatacccacttcaatcgcctgatgatgggtcgccgcataccctaaggaaagcgccagacagatttcatagctgacgaataacagactcccggcgagtaaatagcctttcgggatttgccgaatacgcggaaatccaaccgtgaagattaacagcagcccgcttaatgaatagatagcagctgcgccgccgaccgggccgagcccctcactgacaccgcgaatcaatcctaccatcgtgctccacaggacgatcgctatcagccctatgagcgttgctttttgtcgtgtcatgctcgctgttttgtctctcttgccgttaaaaattaagctgaattttatagcatttttttaactggcctgtcaggcagtggtgcgtttttctaccgctattgaggtaggtcaatttgcgaaggcggattattttgtggcaaacagatgttctttttgatttcgcgcaaaaagattcagaattttactgttagtttcctcgcgcagtaatacccctgaaaaaagaggaaagcaatggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaaca

(The sequence listing continues in the following parts.)

What is claimed is:

1. A strain of E. coli having a genome with the nucleic acid sequence set forth in SEQ ID NO: 1 with the following genes deleted therefrom: b0245-b0301, b0303-b0310, b1336-b1411, b4426-b4427, b2441-b2450, b2622-b2654, b2657-b2660, b4462, b1994-b2008, b4435, b3322-b3338, b2349-b2363, b1539-b1579, b4269-b4320, b2968-b2972, b2975-b2977, b2979-b2987, b4466-b4468, b1137-b1172, b0537-b0565, b0016-b0022, b4412-b4413, b0577-b0582, b4415, b2389-b2390, b2392-b2395, b0358-b0368, b0370-b0380, b2856-b2863, b3042-b3048, b0656, b1325-b1333, b2030-b2062, b2190-b2192, b3215-b3219, b3504-b3505, b1070-b1083, b1878-b1894, b1917-b1950, b4324-b4342, b4345-b4358, b4486, b0497-b0502, b0700-b0706, b1456-b1462, b3481-b3484, b3592-b3596, b0981-b0988, b1021-b1029, b2080-b2096, b4438, b3440-b3445, b4451, b3556-b3558, b4455, b1786, b0150-b0153, b2945, b2699, b0315-b0321, b0323-b0331, and b0333-b0354.

2. A method of producing a polypeptide comprising:
   (a) providing the strain of claim 1;
   (b) transforming the strain with a heterologous nucleic acid encoding the polypeptide operatively linked to an expression control sequence; and
   (c) culturing the transformed strain under conditions suitable to express the polypeptide.

3. A method of introducing a heterologous nucleic acid into a microorganism comprising:
   (a) providing the strain of claim 1; and
   (b) transforming the strain with the heterologous nucleic acid.

4. The method of claim 3 wherein the heterologous nucleic acid is a vector.

5. A method of amplifying a heterologous nucleic acid comprising:
   (a) providing the strain of claim 1;
   (b) transforming the strain with a vector comprising the heterologous nucleic acid; and
   (c) culturing the transformed strain under conditions suitable to amplify amplifying the heterologous nucleic acid.

* * * * *